United States Patent 11,098,302 (IDENTIFICATION OF POLYNUCLEOTIDES ASSOCIATED WITH A SAMPLE) - sequence listing, part 103

SEQ ID NO: 353988 - DNA, 532 bp, Homo sapiens
  misc_feature: GZ8MTXP01EM0C2.52.76.G10.1.454.CMB.2.raw
  modified_base (271)..(271): a, c, t, g, unknown or other
  misc_feature (271)..(271): n is a, c, g, or t
  modified_base (296)..(296): a, c, t, g, unknown or other
  misc_feature (296)..(296): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (403)..(403): a, c, t, g, unknown or other
  misc_feature (403)..(403): n is a, c, g, or t
  modified_base (421)..(421): a, c, t, g, unknown or other
  misc_feature (421)..(421): n is a, c, g, or t
  modified_base (465)..(465): a, c, t, g, unknown or other
  misc_feature (465)..(465): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggaggcgtggtccagcctgggagtccctgagactctcctgtgcaggctctgctattccctnaatactatgctatcgattgggtccnccaggctcgaggcaagggactggagtggtgcagtaatatcagctgatgggagctaataaatnttacgcagtnttcgtgcgtaggggccgatcacgtatactccaganacaactaccaagatatanatataatactaacaaatacgaaactacggacctggactaaccgngaacggacttacggcttagttagttattacgaagttcgcgtcggagggggctaaggttcgaacccgg

SEQ ID NO: 353989 - DNA, 553 bp, Homo sapiens
  misc_feature: GZ8MTXP01DOXQH.52.76.G10.1.454.CMB.2.raw
  modified_base (359)..(359): a, c, t, g, unknown or other
  misc_feature (359)..(359): n is a, c, g, or t
  modified_base (406)..(406): a, c, t, g, unknown or other
  misc_feature (406)..(406): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgaacgttggtacttataactctgtctcctggtaccaacaataccccggcaaacgtcccaaactcatgatcttgagtcagtgatcggcccgcaggggtttctcatcgcttcctccggctccaagtctggcngcacggccctccctgaccatctctggctccaggctgaggacgaggcngattagttactgcagctcatacaacaaacagaaacacgttgggtgttccgggcgggcgggaacccaaacgtcgacccgtaccgtacgttccgacggccccaagggcccgttcgcccccctcgggttccctaacgttccctttccccg

SEQ ID NO: 353990 - DNA, 569 bp, Homo sapiens
  misc_feature: GZ8MTXP01DK986.52.76.G10.1.454.CMB.2.raw
  modified_base (224)..(224): a, c, t, g, unknown or other
  misc_feature (224)..(224): n is a, c, g, or t
  modified_base (364)..(364): a, c, t, g, unknown or other
  misc_feature (364)..(364): n is a, c, g, or t
  modified_base (378)..(378): a, c, t, g, unknown or other
  misc_feature (378)..(378): n is a, c, g, or t
  modified_base (514)..(514): a, c, t, g, unknown or other
  misc_feature (514)..(514): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttgtacttatactctgtctctggtaccaacaactaccccggacaaacgtccccaaactcatgatctttgagtcagtgactcggcccgcgtagggggtttctctatcgcttccgtccggctccaagtctgcngcaccggcctcccngaccatctcgtggctccgaggctgaggacgaggctgattattactgcagcttacataacaacaaagaacgaaacgtccgttggggtacgttcgggcggtaacgggaacccaaacgtcggacccgttccacggttcncggacccgaaggccgtccgtacccccgtcgggttcctaaccgttccgtttccccg

SEQ ID NO: 353991 - DNA, 559 bp, Homo sapiens
  misc_feature: GZ8MTXP01BPYMW.52.76.G10.1.454.CMB.2.raw
  modified_base (363)..(363): a, c, t, g, unknown or other
  misc_feature (363)..(363): n is a, c, g, or t
  modified_base (445)..(445): a, c, t, g, unknown or other
  misc_feature (445)..(445): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgaggtcagtgatcggcccgcagggggtttctcactcgcttcctccggctccaagtctgggcngcaccgggcctccctgaccatctctggctccagctgagcgaggctgattattactgcagtctcatacacaaaccagaaaacncgttagggtgttcgggcgggaacggggaaccgaaactcggacccgtacccgtaacgttacacgggaccccaaggggcctcggccccctcggttacctaaccgttcgttccccgg

SEQ ID NO: 353992 - DNA, 608 bp, Homo sapiens
  misc_feature: GZ8MTXP01D760N.52.76.G10.1.454.CMB.2.raw
  modified_base (243)..(243): a, c, t, g, unknown or other
  misc_feature (243)..(243): n is a, c, g, or t
  modified_base (272)..(272): a, c, t, g, unknown or other
  misc_feature (272)..(272): n is a, c, g, or t
  modified_base (304)..(304): a, c, t, g, unknown or other
  misc_feature (304)..(304): n is a, c, g, or t
  modified_base (326)..(326): a, c, t, g, unknown or other
  misc_feature (326)..(326): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccagcaatgacgttgtacttatactntgtctctggtaccaacaactaccccgganaaacgtcccaaatcatgatctttgagtcagtnagtcggccgtcgtagggtttcncagtcgtcttcgtccgctaccgagtctgacaagcctaacggcctccctcgaccatctcgtcgggctcgaggctggacgacgaggctagtattattacgtgacagtctacactaacaaacgaaaacaagaaaccgtggttaaggggtcggttccgggaccggaccggggaaaccctaaaacgtcggttaaccccggtccttacggaccgaaccgttacccgaacgccgtaacccggtcccccgtcggtacccaccgttcccgtaacccggttcccctcccccg

SEQ ID NO: 353993 - DNA, 751 bp, Homo sapiens
  misc_feature: GZ8MTXP01EQ8CV.52.76.G10.1.454.CMB.2.raw
  modified_base (207)..(207): a, c, t, g, unknown or other
  misc_feature (207)..(207): n is a, c, g, or t
  modified_base (334)..(334): a, c, t, g, unknown or other
  misc_feature (334)..(334): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcacatctccngcactggaaccagcaatgacgtttggtaacttataactctgtctcctaggtaccaacaactaccccggacaaacgtccccaaaatcatgattcttgagtcagtgactcggcccgtcgtagggtttcncattccgtcttccgccggccctaccgtaagtcgtcggcaacgcccgaaccgggtccctcccgttacgaaccctacttccgtacggtcggggtcccttacccggaagggtccgtagggaacggacggtaacgggtcctttagtaacgtttacttaccgtaggacctacgtcccttaacgtaacttaaaaccaaacctaaaaacggaacgtaaaaccgttcggttttacgggggttaccggttccgggggaaccgggacccggtaaaaccggtaaaaccgtttccgggaaaccccggttcccgttaacggtacccgaaccgggttaccccgttaaaacggcccgtttaaccccggacccccccctttaaccggttcctaacccgtttcccgtttaaccccgggtttccccccgtccccg

SEQ ID NO: 353994 - DNA, 540 bp, Homo sapiens
  misc_feature: GZ8MTXP01CPRVO.52.76.G10.1.454.CMB.2.raw
  modified_base (224)..(224): a, c, t, g, unknown or other
  misc_feature (224)..(224): n is a, c, g, or t
  modified_base (321)..(321): a, c, t, g, unknown or other
  misc_feature (321)..(321): n is a, c, g, or t
  modified_base (360)..(360): a, c, t, g, unknown or other
  misc_feature (360)..(360): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttgtacttataactctgtctcctggtaccaacaactaccccggcaaacgtccccaaactcatgatctttgagtcagtgatcggcccgnaggggtttctcatcgcttcctccggctccaagtctggcngcacggcctcctgaccatctctgggctccgagctgaggacgagctgtattatactgctagctacaataacaacaaacagaaaactacgttgggtacgttcgggcggcgggaaccaaacgtcgacccgttctacgttcgacgcccgaaggcctcgcccctggttcctaaccgttcttcccg

SEQ ID NO: 353995 - DNA, 523 bp, Homo sapiens
  misc_feature: GZ8MTXP01B7LXP.52.76.G10.1.454.CMB.2.raw
  modified_base (359)..(359): a, c, t, g, unknown or other
  misc_feature (359)..(359): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
  modified_base (438)..(438): a, c, t, g, unknown or other
  misc_feature (438)..(438): n is a, c, g, or t
  modified_base (481)..(481): a, c, t, g, unknown or other
  misc_feature (481)..(481): n is a, c, g, or t
tcagcgcagtacgacacgaccggtgctcgatttagtcactcatacaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgagtcagtgatcggcccgcagggggtttctcatcgcttctccggcctccaagtctggcaagcncggcctccctgaccatctctcgggctccaggctgaggacgaggctgattattactgcagctnatacanaaacagaaacncgttagggtgttcggcggcgggacaaacgtgaccgtcacgtcngcccgaagcctcgcccctggtccacttcgtcgttccgtcccc

SEQ ID NO: 353996 - DNA, 581 bp, Homo sapiens
  misc_feature: GZ8MTXP01CYKUA.52.76.G10.1.454.CMB.2.raw
  modified_base (329)..(329): a, c, t, g, unknown or other
  misc_feature (329)..(329): n is a, c, g, or t
  modified_base (360)..(360): a, c, t, g, unknown or other
  misc_feature (360)..(360): n is a, c, g, or t
  modified_base (409)..(409): a, c, t, g, unknown or other
  misc_feature (409)..(409): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttgtacttatactctgtctctggtacaacaactaccccggcaaacgtcccaaactcatgatctttgagtcagtgatcggcccgtcgaggggtttcncatcgtcttcctccggctccgaagtctggcngcacggccctccctcgaccactctctcgggctccgaggctggaggacgnggctgattattacgtgtcgagctacaactaacaaacaaacaagtaaacctcgttagggtcgttccgggcgggaaccgggaaccaaacgttcggaacccgttcctaacggttcgacggaccccgaagggtcccttccggccccccgttggaccctaaccgttccgtttccccg

SEQ ID NO: 353997 - DNA, 557 bp, Homo sapiens
  misc_feature: GZ8MTXP01D0HW0.52.76.G10.1.454.CMB.2.raw
  modified_base (325)..(325): a, c, t, g, unknown or other
  misc_feature (325)..(325): n is a, c, g, or t
  modified_base (348)..(348): a, c, t, g, unknown or other
  misc_feature (348)..(348): n is a, c, g, or t
  modified_base (538)..(538): a, c, t, g, unknown or other
  misc_feature (538)..(538): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtaacttataactctgtctcctaggtaccaacaataccccggacaaacgtcccaaactcatgatctttgaggtcagtgatccggcccgngtaggggtttctcatcgcttccnccggctccagtctaggcaagcaccggccctcctgactatctctgggcctcgaggctagaggacgaggtctagtattattactgcaagcttacaactaacaacaaaacagtaaaactcggttgggtgttaccgggcggaacggaacaaagtcgaccgtacgttacgacgcgacccgaacgctccggccccncggttctccttcgttcccg

SEQ ID NO: 353998 - DNA, 552 bp, Homo sapiens
  misc_feature: GZ8MTXP01DUSTU.52.76.G10.1.454.CMB.2.raw
  modified_base (327)..(327): a, c, t, g, unknown or other
  misc_feature (327)..(327): n is a, c, g, or t
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (415)..(415): a, c, t, g, unknown or other
  misc_feature (415)..(415): n is a, c, g, or t
  modified_base (533)..(533): a, c, t, g, unknown or other
  misc_feature (533)..(533): n is a, c, g, or t
tcagcgcagtacgacacgaccggtgctcgatttagtcactcatacaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtcccaaactcatgatctttgaggtcagtgatcggcccgcagggggttttcncgatccgcttctccggcctccaagtctgcaagcncggctcccngaccatctctgggctccaggctgaggacgaggctgattattacgngcagctacaataacaacaaacaagtaaacgtacggtttgggtcggttccgggacgggaccggaaccaaacgtcgaccgtccgttacgacgacgccgacggcctccgccccgtcggtcncttcctccgttcccgtccc

SEQ ID NO: 353999 - DNA, 528 bp, Homo sapiens
  misc_feature: GZ8MTXP01DERVU.52.76.G10.1.454.CMB.2.raw
  modified_base (403)..(403): a, c, t, g, unknown or other
  misc_feature (403)..(403): n is a, c, g, or t
tcagcgcagtacgacacgaccggtgctcgatttagtcactcatacaggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgacgttggtactataactctgtctctggtaccacaatacccggcaaagtcccaaactcatgatctttgaggtcagtgatcggcccgcaggggtttctcatcgcttcctccggctccaagtctgcaagcacggcctccctcgaccagtctctgggctccaggctgaggacgagcngatatactgctagctcatacaacaaacagaaaacacgttggtgttcggcggcgggaccaaacgtcgacggtcctaacgttcgacgcccgaagccgtcgcccccgtcggttccaacgttcttcccg

SEQ ID NO: 354000 - DNA, 511 bp, Homo sapiens
  misc_feature: GZ8MTXP01A5R5U.52.76.G10.1.454.CMB.2.raw
  modified_base (295)..(295): a, c, t, g, unknown or other
  misc_feature (295)..(295): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggaggcgtggtccagcctgggagttcctgagactctctgtgcaggctctgcattcccctcaataactatgctatcgattgggccncaggctcgaggcaagggctggagtgggtgcagtaatactcagctgatgggagcaactaaatatacgcagattcgtgcgaggggccgattcaccatatccagagacaactacccaagatatgatatatcaacaaatgaaactagacctgaacgaacctagagggacacgggtctaggttattattagtgtgccgtggagggggctaaggttggcccg

SEQ ID NO: 354001 - DNA, 618 bp, Homo sapiens
  misc_feature: GZ8MTXP01B3R5T.52.76.G10.1.454.CMB.2.raw
  modified_base (220)..(220): a, c, t, g, unknown or other
  misc_feature (220)..(220): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctcgtgtctgggtctctggacagtcgatcacatctctgcactggaaccngcaatgacgttgtacttataactctgtctctggtaccaacaataccccggacaaacgtcccaaactcatgatcttgagtcagtgactcggccgcgtaggggttctcagtcgtcttcctccggtctccgtaagtcgtgcaacgcacgggccctccctgacctactctccgtcgggctccgacggccgtagaacggtacggaggtctaggtactttacttaacgttgacaagtcctacaactaacaaacaaaaccaagaaacctacgttacggggtacgtttccggggaccgggtaacggaacccttaaacgtccggttacccgtaccgtaaccgttcgacggccccgaaacgggcccttccgacccccgtcggttaccctaaccgtttccgttccccgg

SEQ ID NO: 354002 - DNA, 652 bp, Homo sapiens
  misc_feature: GZ8MTXP01AB9E8.52.76.G10.1.454.CMB.2.raw
  modified_base (368)..(368): a, c, t, g, unknown or other
  misc_feature (368)..(368): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaactaccccggacaaacgtccccaaaactcatgatctttgaggtcagtgagtcggcccgcgtaggggtttctcatcgtcttccgtccggctcaagtctggcngcacggctccctgaccatctctgggcctccgaggctaggacggacgacggtctggtattaattacctggaccagtccttacaaacgtaaccaaacgaaaacaaacgtaaaaaccgtacggtttggggtcggtttacggggccggggtaaccggggaaaccccttaaaacggttccggttaaacccgggttaccctaaccgttaccgacccgttaccccggaaacgggtcccgtaacccggtcccccccgtacggggttacctaacccgttccgtttcccccggg

SEQ ID NO: 354003 - DNA, 516 bp, Homo sapiens
  misc_feature: GZ8MTXP01DJWD7.52.76.G10.1.454.CMB.2.raw
  modified_base (329)..(329): a, c, t, g, unknown or other
  misc_feature (329)..(329): n is a, c, g, or t
  modified_base (362)..(362): a, c, t, g, unknown or other
  misc_feature (362)..(362): n is a, c, g, or t
  modified_base (395)..(395): a, c, t, g, unknown or other
  misc_feature (395)..(395): n is a, c, g, or t
  modified_base (416)..(417): a, c, t, g, unknown or other
  misc_feature (416)..(417): n is a, c, g, or t
  modified_base (419)..(420): a, c, t, g, unknown or other
  misc_feature (419)..(420): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttgtacttataactctgtctctggtaccaacaataccccggacaaacgtcccaaaactcatgatctttagaggtcagcgatcggccgcagggggtttcncgatcgtctctccggctccaagtctgcaacgcncggcctccctgaccatctctgggctccaggtcnggagacgaggctgatattacnncnncacanacacaaanagactgtggtgtcggcggacgaacaactcgaccgtcttacgcacgaccgcgcctccgcccgtcgctcttcctccgttccctcc

SEQ ID NO: 354004 - DNA, 714 bp, Homo sapiens
  misc_feature: GZ8MTXP01BTKXI.52.76.G10.1.454.CMB.2.raw
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (277)..(277): a, c, t, g, unknown or other
  misc_feature (277)..(277): n is a, c, g, or t
  modified_base (298)..(298): a, c, t, g, unknown or other
  misc_feature (298)..(298): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttctttaagaggtgtccagtgtcaggtgcagctggtggagtctgggggagcgtggtccagcctgggagtccctgagactctcctgtgcaggctntgctattcccctanaatactntgctatcgtagttcgggcccncgaggcctccgaggacgaaggggtctgggaggtggggtacgactaagtaactacgtacgaggtctaggagtagggaacgtaactaaacgttaaagttacgttacgctaaggtactttcgtacgggacgggtacggggtaccgtacgttaccgaaccgtaacgttaccgtaccgaacggaaaccgtaaacccgtaaacccgtaacccgtaaagtaacgttaacgtaacgtaaacttaaacgttaactaaccgtaaacgtaaacgtaacgtaaaccgtacggtacccgtacggtaaaccggtaacccggtagggaaaccgggtaaccgttaccgggtaacgttaggttaaacgttacgttacggtcggtacggtccgggttacgggacgggggttaccgtaacgggttccggtccggg

SEQ ID NO: 354005 - DNA, 752 bp, Homo sapiens
  misc_feature: GZ8MTXP01A4VB5.52.76.G10.1.454.CMB.2.raw
  modified_base (221)..(221): a, c, t, g, unknown or other
  misc_feature (221)..(221): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttggtacttatactctgtctctgtaccaacactaccccgacaacgtcccaaactcatgattctttgagtcagcgacgtccggcccgtcgtacgggggtttctcgtacttccgtctttccgtcccgggtccccttacccgtaaacggttccgtacgggacccgaaacggcccgaacccgggtccccttcccccgtacggtaacccctaacgttcccgttccggtcgggggtcccttcccggaacgggtccgttacgggaacgggaacggtacggggtacctttaggtaaactttacgttaaccgttgggacctacggtaccgtacgtaaacttaaaccaaaccaaaacgaaacgaaaacgttcggtttaacgggggttcggttaccggggaccgggtaccggggaacctaaacggtccggttaacccgttacccgttaacggtaccaaccggaccccgaacggttcccgtcccggtacccccgtcggtaccctacttcccgttccgttaaccccgtaaccccg

SEQ ID NO: 354006 - DNA, 493 bp, Homo sapiens
  misc_feature: GZ8MTXP01DHZIK.52.76.G10.1.454.CMB.2.raw
  modified_base (273)..(273): a, c, t, g, unknown or other
  misc_feature (273)..(273): n is a, c, g, or t
  modified_base (297)..(297): a, c, t, g, unknown or other
  misc_feature (297)..(297): n is a, c, g, or t
  modified_base (333)..(333): a, c, t, g, unknown or other
  misc_feature (333)..(333): n is a, c, g, or t
  modified_base (360)..(360): a, c, t, g, unknown or other
  misc_feature (360)..(360): n is a, c, g, or t
  modified_base (463)..(463): a, c, t, g, unknown or other
  misc_feature (463)..(463): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggaggcgtggtccagccgtgggaggtccctgagactctcctgtgcaggctctgctattccctnaatactatgctatcgattgggccncaggcctcaggcaagggctggagtggtgcagtatancagctgatggagcaactaaatatacgnagtattctgcgagggcgatcacatactcagagacaactaccaagatatgatatatactacaaatagaactagcctgagaactgaggacacggactgttaattnttactgtgcgtcgagggggcaagttcgccg

SEQ ID NO: 354007 - DNA, 537 bp, Homo sapiens
  misc_feature: GZ8MTXP01BB6AF.52.76.G10.1.454.CMB.2.raw
  modified_base (354)..(354): a, c, t, g, unknown or other
  misc_feature (354)..(354): n is a, c, g, or t
  modified_base (363)..(363): a, c, t, g, unknown or other
  misc_feature (363)..(363): n is a, c, g, or t
  modified_base (458)..(458): a, c, t, g, unknown or other
  misc_feature (458)..(458): n is a, c, g, or t
tcagcgcagtacgacacgaccggtgctcgatttagtcactcatacagggcacgaccggtgctcgatttagtcactcatacagggggctggggtctcaggaggcagcgctctcgggacgtctccaccatggcctgggctctgctattcctcaccctctcactcagggcacagggtcctgggcccagtctgccctgactcagcctgcctccgtgtctgggtctcctggacagtcgatcaccatctctgcactggaaccagcaatgacgttggtacttataactctgtctcctaggtaccaacaactaccccggacaaacgtccccaaatcatgatcttgacgtcagtgatcgccgngtgggttcncatcgtcttctcggctccgagtctggcacgcacggcctcctgaccatctcgtgggctcgaggtcctggacggacgaggctagtacttatactgcncgtcttcaattaccaacgaaacgacgaaacttacgttgggtacgttcgggacggtcgggaacctaacgttcgtaacccg

SEQ ID NO: 354008 - DNA, 580 bp, Homo sapiens
  misc_feature: GZ8MTXP01C7YPL.52.76.G10.1.454.CMB.2.raw
  modified_base (204)..(204): a, c, t, g, unknown or other
  misc_feature (204)..(204): n is a, c, g, or t
  modified_base (316)..(316): a, c, t, g, unknown or other
  misc_feature (316)..(316): n is a, c, g, or t
tcagcgcagtacgacacgaccggtgctcgatttagtcactcatacaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcnctgcactggaaccagcaatgacgttggtacttataactctgtctcctggtaccaacaataccccggacaaagtccccaaaactcatgatctttgaggtcagtgatcggccgnagggggtttctcgatcgcttctccggcctccaagtctggcaagcaacggccctccctgaccatctctgggctccgaggctgaggacgagggctgtatttagtactggacagcgttacataaacacaaaacaagaaactacgtttaggggtacgttcgggacggccggggaacctaaaacgtcggaaccgtcccgttacgtaccacgaccccgttaaaggccttcgccccgtcggtccacttcctttaacgttcccgttaacccc

SEQ ID NO: 354009 - DNA, 591 bp, Homo sapiens
  misc_feature: GZ8MTXP01CPPT7.52.76.G10.1.454.CMB.2.raw
  modified_base (318)..(318): a, c, t, g, unknown or other
  misc_feature (318)..(318): n is a, c, g, or t
  modified_base (329)..(329): a, c, t, g, unknown or other
  misc_feature (329)..(329): n is a, c, g, or t
  modified_base (364)..(364): a, c, t, g, unknown or other
  misc_feature (364)..(364): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttgtacttatactctgtctctggtaccaacaactaccccggacaaacgtcccaaactcatgatcttgagtcagtgatcggcccgngtagggtttcncatcgtcttccctccggctccgtaagtctacggcngccaccgggtcctccctgacctatctcgtgggcctccgaggcctggacggacgaggtctgattatactgcagccttacaactaacaacaaaacgagaaacgtacgttagggtcgttaccggggcgggaaccggggtaaaccaaacgtcggaaccccgttaccgtacgttaccgaccgcccgtaaggccctaaccgcccccgtcggttcctaaccgttccgttccccg

SEQ ID NO: 354010 - DNA, 585 bp, Homo sapiens
  misc_feature: GZ8MTXP01CGY1Q.52.76.G10.1.454.CMB.2.raw
  modified_base (229)..(229): a, c, t, g, unknown or other
  misc_feature (229)..(229): n is a, c, g, or t
  modified_base (239)..(239): a, c, t, g, unknown or other
  misc_feature (239)..(239): n is a, c, g, or t
  modified_base (503)..(503): a, c, t, g, unknown or other
  misc_feature (503)..(503): n is a, c, g, or t
tcagcgcagtacgacacgaccggtgctcgatttagtcactcatacagggcacgaccggtgctcgatttagtcactcatacagggggctggggtctcaggaggcagcgctctcgggactctccaccatggcctgggctctgctattcctcaccctcctcactcagggcacagggtcctgggcccagtctgccctgactcagcctgcctccgtgtctgggtctcctggacngtcgatcacntctctgcactggaaccagcaatgacgttggtacttataactctgtctcctgtaccaacaactaccccggacaaacgtccccaaaactccatgtaatctttagacggtcagtgatcggacccgcgtaacggggtttctcgattccgcttccgtccgggcttacccgaagttcctggcacgccgaaccggcccttccctcgaccctactcctcgtcgggtccttccgaggcctaggaacggacgacgggctaggtacttagttacngtcaagtccttacattaacgaacaaacaaggaacttacgttgggtacgttcggacggacggacctaaacgttcgtaaccccg

SEQ ID NO: 354011 - DNA, 720 bp, Homo sapiens
  misc_feature: GZ8MTXP01EQW2Y.52.76.G10.1.454.CMB.2.raw
  modified_base (191)..(191): a, c, t, g, unknown or other
  misc_feature (191)..(191): n is a, c, g, or t
  modified_base (237)..(237): a, c, t, g, unknown or other
  misc_feature (237)..(237): n is a, c, g, or t
  modified_base (270)..(270): a, c, t, g, unknown or other
  misc_feature (270)..(270): n is a, c, g, or t
  modified_base (300)..(300): a, c, t, g, unknown or other
  misc_feature (300)..(300): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtncagctggtggagtcgtgggggagcgtgtccagcctgggacgtcccngagctctctgtgcaggctctgctattcccctanaattaactatgctatcgagtttcggggccncgaggctccgaagggcaaggggactgggtaggtgggggtgactaaaggttaactacgtcgagtcgttaggagttaggggaacggtaacctaaattaaaagttcttaacggctaaagggtcttttacgtgggaccggtaacgggggacccgtacgtttaccgaacccgtaattaacgtacccgaaaggtaacgaaaccctaaaccggttaaaccccaaaggtaacgttaacttaaggttaaacttaattaaacttaaccgtaaaccgtaaaattaacgggtaaaccctagggaccccttaagggaaccggtaacccggtaaggaaacgggaaccgttacgggtccttaaggttaaccgttaatttaccgtaagggtcggtccgggttacgggacggggggttcctaagggttcggtcccgg

SEQ ID NO: 354012 - DNA, 528 bp, Homo sapiens
  misc_feature: GZ8MTXP01EFHGF.52.76.G10.1.454.CMB.2.raw
  modified_base (270)..(270): a, c, t, g, unknown or other
  misc_feature (270)..(270): n is a, c, g, or t
  modified_base (339)..(339): a, c, t, g, unknown or other
  misc_feature (339)..(339): n is a, c, g, or t
  modified_base (446)..(446): a, c, t, g, unknown or other
  misc_feature (446)..(446): n is a, c, g, or t
  modified_base (488)..(488): a, c, t, g, unknown or other
  misc_feature (488)..(488): n is a, c, g, or t
  modified_base (498)..(498): a, c, t, g, unknown or other
  misc_feature (498)..(498): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttctttaagaggtgtccagtgtcaggtgcagctggtggagtcgtgggggagcgtggtccagcctggggagtccctgagactctcctgtgcaggctctgcattcccctnaatactatgctatcgattgggtccgcaggcctaccgaggcaaaggggctgggagtgggtggcagtatancagctgatgggagcaactaaatattacgcaaggtattcgtggcgtacgggggcctattcacctatactccaagagaccaactacccaaagtacgtaatgaattaatntaactacaaatgaactagcctagagaactgaacggcacgggntaggttattnttcgaagtgcgtgacgggggngtcgngtcg

SEQ ID NO: 354013 - DNA, 617 bp, Homo sapiens
  misc_feature: GZ8MTXP01BP71R.52.76.G10.1.454.CMB.2.raw
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
tcagcgcagtacgacacgaccggtgctcgatttagtcactcatacagggcacgaccggtgctcgatttagtcactcatacagggggctggggtctcaggaggcagcgctctcgggacgtctccaccatggcctgggctctgctattcctcaccctcctcactcagggcacgagggtcctgggcccagtctgccctgactcagcctgcctcgtgtctggtctccgtggacagtcgatcacntcctctgcactgaacngcatgacgttgtacttatactctgtctctacgtacaacactacccgactaacgtaccccaaactcatgtacttcgtttagaacgtcagtgtacgtccggcccgtacgtcgggtttctacgtactccgttccgttccgtccggtctacccgtagtcgtggcgacgcccgtacccggtccttcccgacgtacctactccgtcgtccgggtccgtccgaggtccgtaggacggtaccggtaggtcgttacgtaattaccttacgtcgcaacgtcttactaacttaacgaaactaaacgttaacgttacgttacgtttaacggggtccggaacggtaccggaccttaacgtcgttaaccgtcccg

SEQ ID NO: 354014 - DNA, 572 bp, Homo sapiens
  misc_feature: GZ8MTXP01DQYCH.52.76.G10.1.454.CMB.2.raw
  modified_base (323)..(323): a, c, t, g, unknown or other
  misc_feature (323)..(323): n is a, c, g, or t
  modified_base (335)..(335): a, c, t, g, unknown or other
  misc_feature (335)..(335): n is a, c, g, or t
  modified_base (452)..(452): a, c, t, g, unknown or other
  misc_feature (452)..(452): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacgagggtcctgggcccagtctgccctgactcagcctgcctccgtgtcgtgggtctcctggacagtcatcaccatctcctgcactggaaccagcaatgacgttgtacttatactctgtctcctgtaccaacaactaccccggacaaacgtccccaaactcatgatctttgagtcagtgacgtcggcccgngtacgggtttcncattcgcttccctccggctccgaagtctgggcaagccaccggccctcctgacctatcctcgtcgggcctccgaggcgtaggagggacgagctagtattattactgcgtatctacaanaacaaacaaacagaaaacctcgttggggtcgtcggcgggaacggaaaccaacgtcgttaccgtcgtacgttacgcgacccgaaggcctccgccccgtggttacctaacgttccgttcccg

SEQ ID NO: 354015 - DNA, 572 bp, Homo sapiens
  misc_feature: GZ8MTXP01BHRKP.52.76.G10.1.454.CMB.2.raw
  modified_base (270)..(270): a, c, t, g, unknown or other
  misc_feature (270)..(270): n is a, c, g, or t
  modified_base (311)..(311): a, c, t, g, unknown or other
  misc_feature (311)..(311): n is a, c, g, or t
  modified_base (356)..(356): a, c, t, g, unknown or other
  misc_feature (356)..(356): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccagcaatgacgttgtacttatactctgtctctgtaccaacacaccccganaacgtcccaaactcatgatctttgagtcagcgagtcgccgngtacgggtttctgatcgtcttctccggctccgagtctggcaagcncggcctccncgaccntcgtcgtgggctcgaggctagacggacgaggtctagtattaactctgacgatctacataacaaactaaacacgaaactgttacggggcgttcgggaccgggacggtaaccaaacgtcggaccgttaccgacgtaccgacgttacccgaggcccttccgcccccgtggtaccctacgttccttaaccgttcccctaaccccg

SEQ ID NO: 354016 - DNA, 573 bp, Homo sapiens
  misc_feature: GZ8MTXP01BSY6M.52.76.G10.1.454.CMB.2.raw
  modified_base (372)..(372): a, c, t, g, unknown or other
  misc_feature (372)..(372): n is a, c, g, or t
  modified_base (469)..(469): a, c, t, g, unknown or other
  misc_feature (469)..(469): n is a, c, g, or t
  modified_base (501)..(501): a, c, t, g, unknown or other
  misc_feature (501)..(501): n is a, c, g, or t
tcagcgcagtacgacacgaccggtgctcgatttagtcactcatacagggcacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatccaccatcctcctgcactggaaccagcaatgacgttggtacttataactctgtctcctggtaccaacaactaccccggacaaacgtcccccaaatcatgatctttgacgtcagtgactcggcccgcgtgggtttcncatcgcttccgtccggctccgaagtcgtggcagccaccgggtccctccccgtgacctctcctcgttcgggcctcccgaagggcctaggacggaccgngggcctaggtatttatacgtgacaacgtcttnacttacgaacaaacacggaaacttacgttggggtcgttccggggcggacgggaacctaacgttcgaaccccg

SEQ ID NO: 354017 - DNA, 540 bp, Homo sapiens
  misc_feature: GZ8MTXP01ALC1P.52.76.G10.1.454.CMB.2.raw
  modified_base (274)..(274): a, c, t, g, unknown or other
  misc_feature (274)..(274): n is a, c, g, or t
  modified_base (340)..(340): a, c, t, g, unknown or other
  misc_feature (340)..(340): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttgtacttataactctgtctctggtaccaacaatacccggnaaacgtcccaaactcatgatctttgaggtcagtgatcggcccgcaggggtttctcatcgcttcccnccggctccaagtctgcaagcacgggcctcctcgacatctctgggctccagggctgaggacgaggctgattagtactgacagctcatacaacaaacagaaaacctcgttaggggtcgttcgggccgggcgggaacccaaacgtgacccgtcctaacgttcgacgccaagggctccggcccctcggctaaccgttcttcccg

SEQ ID NO: 354018 - DNA, 741 bp, Homo sapiens
  misc_feature: GZ8MTXP01BHYDI.52.76.G10.1.454.CMB.2.raw
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggagcgtggtccagcctgggagtccctgagactctcctgtgcaggctctgctattcccctanaatactatgctagtcgtagttcgggccncgaggcctacgaggacgaagggtcgtgggaggtggggtgacgtaagtaatacgtcgagtcgtaggacgtaagggaacgtaactaaacgttaaaagttacgttaaccggagtaacggtatttccggacgggaccggggtaacgggggtacccgtaagttacccgaaacccgttaaagttaaccgtaaccgaaacgggtaaaccgtaaaccctaaacccgtaaccccgtaaaaggtaagttaaacgttaacgtaaattaaacttaacctaaccgttaaaacgtaaaagtaacgaaaaccgtacggtacccgtaacgggaaacgtaacccgtaaggggaaccgggtaaaccgttaacggggtacttaaggttaacgtttacgttacggtgggtaccgggtccggttacgggggacgggggttacctaagggttccggaacccgg

SEQ ID NO: 354019 - DNA, 653 bp, Homo sapiens
  misc_feature: GZ8MTXP01B6YVT.52.76.G10.1.454.CMB.2.raw
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttgtacttatactctgtctctgtaccaacaactaccccggacaaacgtccccaaactcatgatctttgaggtcagtgacgtcggcccgtcgtacgggggtttctcgtatcgtcttccgtccggccctaccgaagtcgtcggccgaacgccgaaccggtccctccctacgacctactccgtcgtcgggcctcgaggctaggaggacgaggctagtattattacgtgacacgtcgtacaactaaccaaactaaaacgaacgtaaaccgtacggttacggggtcggtaccggggaccgggtaccggaaaccgtaaaccggtccgttacccgttacccgttaacggtaccaaccgggttaccccgaacggccctcccggtcccccgtcggttacccaccgttcccgtcccgggtttccccgtccccg

SEQ ID NO: 354020 - DNA, 576 bp, Homo sapiens
  misc_feature: GZ8MTXP01CCM3F.52.76.G10.1.454.CMB.2.raw
  modified_base (295)..(295): a, c, t, g, unknown or other
  misc_feature (295)..(295): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggagcgtggtccagcctgggagtccctgagactctcctgtgcaggctctgcattccctcaataactatgctatcgattgggtccncaggctccgaggcaagggctggagtgggtgcagtaatctcagctgatgggagcaactaaatattacgcagtattcgtgcggtacgggggccgattccaccgtatactcccgaaggacgaacaacctacccaaagtactaagttaggaattaataacttacctaaacaaattacggaaactacgacccttaggaacgaaccctggaaaccggacaacggggtctaggttaacgttacttaccgtggtagcggttcgaggggggttcctaaggttcgtcccgg

SEQ ID NO: 354021 - DNA, 709 bp, Homo sapiens
  misc_feature: GZ8MTXP01AZ8MC.52.76.G10.1.454.CMB.2.raw
  modified_base (221)..(221): a, c, t, g, unknown or other
  misc_feature (221)..(221): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttgtacttataactctgtctctggtaccaacaactaccccggacaaacgtccccaaactcatgatctttgaggtcagtgactcggcccgcgtaggggtttctcacgtcgtcttccgtccggcctaccaagtctggcaacgccaaccggccctccctcgacctactctcgtcgggcctccgaggtccgtaggaacgggacggaacgggtcttaggtaactttagtttaccgtcgtacgtacgtactaactaactaaaccaaaccgtaaaaccgtaaacgtaaaccgttacgggtttacggggttaccggggttaccggggacccgggtaacccggggtaaacccgtaaaccggtcccggttaaccccgttacccgttaaccggtacccgaacccggacccgttaccgggttcccgttccccggtcccccgttccggtaccctacccgtttcccgttaaccccgtttcccccgtaaccccg

SEQ ID NO: 354022 - DNA, 562 bp, Homo sapiens
  misc_feature: GZ8MTXP01EE7P8.52.76.G10.1.454.CMB.2.raw
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
  modified_base (341)..(341): a, c, t, g, unknown or other
  misc_feature (341)..(341): n is a, c, g, or t
  modified_base (368)..(368): a, c, t, g, unknown or other
  misc_feature (368)..(368): n is a, c, g, or t
  modified_base (545)..(545): a, c, t, g, unknown or other
  misc_feature (545)..(545): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctgggtggagtcgtgggggagcgtggtccagccgtgggagtcctgagctctctgtgcaggctctgctattccctanaataactatgctatcgagtttcgggccnccaggcctcgaggcaagggctgggagtgggtagcaagtaactncgagctgagtgggacgcaaattaaatnttacgctagtattctggcggaggggacccgtattaccaacctaagtactaccgaagaacgaacaacctaccaaagattaagtagtaataataatactaaacgtaaatacggaaacacgaccgtagacgaaccgtaggacggtacacggtctagttattacttagtgtagcgtacggnggggctaacggcgtccg

SEQ ID NO: 354023 - DNA, 670 bp, Homo sapiens
  misc_feature: GZ8MTXP01DR5J6.52.76.G10.1.454.CMB.2.raw
  modified_base (220)..(220): a, c, t, g, unknown or other
  misc_feature (220)..(220): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcatggaaccngcaatgacgttgtacttataactctgtctctggtaccaacaactaccccggacaaacgtaccccaaactcatgatctttgaggtcagtgatccggccgctagggggtttctcatcgcttctccggcctccaagtctggcaacgtcgccggtcctccctagaccctactcgtcgtcgggccttacgcgggtctacggacggacgaaggtcttagtaagtttacttacgtgacaacgtctacaactaaaccaacgaaaaactaacgaaactacgtttacgggggtacgttaccggggaccggggaccgggtaaaccaaaaccgttcggaaccccggttaccgttaaaccgggttacctacggaacccccgttaaaggggaccccttcccgggtaccccccgttcggggttaccctacccggtttaccgttccccgggtttcccccgtccccc

SEQ ID NO: 354024 - DNA, 724 bp, Homo sapiens
  misc_feature: GZ8MTXP01DRXB8.52.76.G10.1.454.CMB.2.raw
tcagcgcagtacgacacgaccggtgctcgatttagtcactcatacagggcacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctcgtgtctggtctctggacagtcgatcaccatctctgcactggaaccagcaatgacgtggtacttataactctgtctcctgtaccaacaataccccggcaaacgtccccaaactcatgatcttgacgtcagtgatcggaacccgcgtaagggggtttctcgactcgtcctttcctccgggtcctacccgtaaagttccgtcgggaccacggccgaacccggggtccccttccccgttaccggaacccacttcccgttccgtttccgggggccctttacccgaacggggtccgttacgggaacggggtaaccccggaaagggtcccgttagggtaacgtttaaactttaaaccgttcggtacccgaaacgggtcccttaccaaacttaaccgaaaaccaaaaaccgttaaacggaaaaccgttaaccggtttaacgggggttacgggtttaacccgggggtacccggggtacccggggaaacccgtaaaacccggttccgggtttaaaaccccccggg

SEQ ID NO: 354025 - DNA, 581 bp, Homo sapiens
  misc_feature: GZ8MTXP01EDK4X.52.76.G10.1.454.CMB.2.raw
  modified_base (328)..(328): a, c, t, g, unknown or other
  misc_feature (328)..(328): n is a, c, g, or t
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
  modified_base (397)..(397): a, c, t, g, unknown or other
  misc_feature (397)..(397): n is a, c, g, or t
  modified_base (408)..(408): a, c, t, g, unknown or other
  misc_feature (408)..(408): n is a, c, g, or t
  modified_base (426)..(426): a, c, t, g, unknown or other
  misc_feature (426)..(426): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctctggacagtcgatcaccatctcctgcactggaaccagcaaatgtaacgttggtaacttataactctgtctcctggtaccaaacaataccccggacaaaagtccccaaactcatgaatctttgaggtcagtgatcggcccgnagggttncatcgcttcnccggctccaagtcnggcngcacggcctcctgaccatctctgggctccgaggnagaggacgagngtagtatattatgcgacnctacaacaacaaacaaacaaacgtaaacgtacgttgggtacggtacgggccgggaaccgggtaaccgaaaccgtaccgttaccgtaccgtaccgttaccgaccgaccgaacgtaccgtcccgtccccgtccgttaccgtaaccgttccgttcccg

SEQ ID NO: 354026 - DNA, 680 bp, Homo sapiens
  misc_feature: GZ8MTXP01C8P29.52.76.G10.1.454.CMB.2.raw
  modified_base (195)..(195): a, c, t, g, unknown or other
  misc_feature (195)..(195): n is a, c, g, or t
  modified_base (206)..(206): a, c, t, g, unknown or other
  misc_feature (206)..(206): n is a, c, g, or t
  modified_base (209)..(209): a, c, t, g, unknown or other
  misc_feature (209)..(209): n is a, c, g, or t
  modified_base (223)..(223): a, c, t, g, unknown or other
  misc_feature (223)..(223): n is a, c, g, or t
  modified_base (342)..(342): a, c, t, g, unknown or other
  misc_feature (342)..(342): n is a, c, g, or t
  modified_base (413)..(413): a, c, t, g, unknown or other
  misc_feature (413)..(413): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccntcnctgcactggaaccngcaatgtacgttgtaacttataactctgtctctgtaaccaacaactaccccggacaaaccgtacccctaaactcatgattcgtttagagtcagtgacgtcggcccgtgtacgggtttcncgtagtcgtccttccccgtccggctacgtaagtccgtagggactcgccaccgggtccctcccgtacacctntccctcgttcgcctcgaggccgtaggacggacggagtcgtagtattattacgcgacggtactcctaacaaacttaaaccaaaacctaaaacgaacgtaaaccgtacggttcggggttacggtccggggaacgggaacccgggtaaacccttaaaacgggttcccgaaacccggttacccgtaacggttacccgaccggaaccccgttaacgggcccttccccggtcccccggttacgttacccgtaaccgttcccgtttcccccggg

SEQ ID NO: 354027 - DNA, 571 bp, Homo sapiens
  misc_feature: GZ8MTXP01D14JG.52.76.G10.1.454.CMB.2.raw
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
  modified_base (360)..(360): a, c, t, g, unknown or other
  misc_feature (360)..(360): n is a, c, g, or t
  modified_base (442)..(442): a, c, t, g, unknown or other
  misc_feature (442)..(442): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggagcgtggtccagccgtgggaggtccctgagactctctgtgcaggctctgctattcccctnaataactatgctatcgattcgggccncaggctccaggcaagggctggagtgggtgcagtatactcagctagatgggagcaactaaatnttaccgataggtattctgacggaggggccagttcaaccatactaccaagacacaactaccaagatatgaatatatacctaanaaatacgaaacacgtacctagaacggaaccctaggaacggacgaaccgggtacttaaggttaaccttagtttaaccgtggtacggtccgggttaccgggaaggggggccctaagggttccgtccccggg

SEQ ID NO: 354028 - DNA, 561 bp, Homo sapiens
  misc_feature: GZ8MTXP01CCYNO.52.76.G10.1.454.CMB.2.raw
  modified_base (297)..(297): a, c, t, g, unknown or other
  misc_feature (297)..(297): n is a, c, g, or t
  modified_base (332)..(332): a, c, t, g, unknown or other
  misc_feature (332)..(332): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (443)..(443): a, c, t, g, unknown or other
  misc_feature (443)..(443): n is a, c, g, or t
tcagcgcagtacgacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggacaaacgtccccaaactcactgatntttgaggtcagtgatcggcccgcgagggggtttcncatcgcttctccgtcctccaaagtctaggcaaagcaacggcctccctgaccatctctgggctcagctgaggagaggctgattattacgnacanctacaacaacaaacaaanacgtaaactagttggtcggtcggccgggacggaacctaaacgtcgacccgtacttacgtacgacgaccgacgttccctccgccccgttcgtctccttaccgtcccgttaaccctcccg

SEQ ID NO: 354029 - DNA, 668 bp, Homo sapiens
  misc_feature: GZ8MTXP01D90O2.52.76.G10.1.454.CMB.2.raw
  modified_base (227)..(227): a, c, t, g, unknown or other
  misc_feature (227)..(227): n is a, c, g, or t
  modified_base (355)..(355): a, c, t, g, unknown or other
  misc_feature (355)..(355): n is a, c, g, or t
tcagcgcagtacgacacgaccggtgctcgatttagtcactcatacagggcacgaccggtgctcgatttagtcactcatacagggggctggggtctcaggaggcagcgctctcgggactctccaccatggcctgggctctgctattcctcaccctcctcactcagggcacgagggtcctgggcccagtctgccctgactcagcctgcctcgtgtctggtctctggacngtcgatcacatctctgcactggaaccagcaatgacgttggtacttataactctgtctcctgtaaccaacaactaccccggacaaacgtccccaaactcatgatcttgacgtcagtgactccggcccgngtaacggggtttctcgtattccgtccttccgtccgggtcctacctaagttctcgggcacgcccgaaccgggtcccttacccgtacgaccctattccgtccgttcggggtcccttccgaacgggtccgttacgggacggaacccggaggttccgttaaggtacttttaaacgttaccgttcggctaacgtcttacctaaacttaaaccgaaaccgaaaaacttaacgttaaaaccgttacgggtttaaggggtcggtttaaccggggaccgggaccgggttaaaccctaaacccggttccggttaaacccccgg

SEQ ID NO: 354030 - DNA, 733 bp, Homo sapiens
  misc_feature: GZ8MTXP01EVZZI.52.76.G10.1.454.CMB.2.raw
  modified_base (338)..(338): a, c, t, g, unknown or other
  misc_feature (338)..(338): n is a, c, g, or t
  modified_base (466)..(466): a, c, t, g, unknown or other
  misc_feature (466)..(466): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtcgtgggtctcctggacagtcgatcaccatctcctgcacgtggaaccagcaatgtacgttgtacttataactctgtctcctggtaccaaacaactaccccggacaaacgtccccaaactcatgattctttgaggtcagtgagtcggcccgcgtaggggtttcncatcgtcttccgtccggccctacctaagtcgtggccgaacgtccgaaccggtcctcccgtacgaccctactcgtcgtcgggtctccgaggtctaggaggacgacggtcgttaggtaactttagttcgngtacgacgtacctactaactaaaccgaaaccaaaaccgaacgtaaaaccgttcggttacgggggttacggttaccggggacccggggaccggggtaaaaccctaaaccgggtcccgttaaccccggttaacccgttaccgggtacccgtaacccgggttaacccccggaaacgggttcccccgtaacccgggtccccccgttaaccggggtaacccctacccgtttccccgggtttaaccccgttaacccccccgtttaaccccccg

SEQ ID NO: 354031 - DNA, 657 bp, Homo sapiens
  misc_feature: GZ8MTXP01BKCE7.52.76.G10.1.454.CMB.2.raw
  modified_base (240)..(240): a, c, t, g, unknown or other
  misc_feature (240)..(240): n is a, c, g, or t
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttgtacttanaactctgtctctggtaccaacaactaccccggacaaacgtccccaaactcatgattctttgagtcagtgagtccggcccgcgtacggggtttctcagtcgcttctccggcctccagtctggcaacgcncggcctccctgaccntctcgtcgggctcgaggctgaggagaggctgtattatacgtgacagctacaactaaccaaacaaaacgaacgaaaccgttacgttacgggggttcgttcccggggaccgggtacccggggtaaaccctaaaaccgtccggttaaaccccggttaccccgttaaaccggtacccgaaccggacccccgttaaagggccccgttaaccccggtcccccccgttaaccgggttacccctaccgttccccgtttcccgggtttccccccgttcccccc

SEQ ID NO: 354032 - DNA, 695 bp, Homo sapiens
  misc_feature: GZ8MTXP01DVO4H.52.76.G10.1.454.CMB.2.raw
tcagcgcagtacgacacgaccggtgctcgatttagtcactcatacagggcacgaccggtgctcgatttagtcactcatacagggggctggggtctcaggaggcagcgctctcgggacgtctccaccatggcctgggctctgctattcctcaccctcctcactcagggcacgagggtcctgggcccagtctgccctgactcagcctgcctcgtgtctggtctcctggacagtcgatcacatctctgcactggaaccagcaatgacgttgtacttataactctgtctcctggtaaccaacaactaccccggacaaacgtaccccaaactcatgatcttgacgtcagtgacgtccggacccgtcgtaacggggtttctaccgacttccggtccttccgtcccgggtacttacccgtaaagttccgtcggacgaacggcccgaaacccgggtccccttaccccgtacggtaacctaccttccgttaccgttccggggtccttacccgaacggggtcccgttagggaacgggtaaccggacggtaccgttaggtaactttaacgttaaccgttcgaccggaacgtaccttactaaaccttaaaccgaaacaaaacgttaaacgttaaaaccgttacggtttgggggtacggttccgggaccggggaccgggaacccgtaaaccgttcgggtaaacccccg

SEQ ID NO: 354033 - DNA, 567 bp, Homo sapiens
  misc_feature: GZ8MTXP01E2V45.52.76.G10.1.454.CMB.2.raw
  modified_base (191)..(191): a, c, t, g, unknown or other
  misc_feature (191)..(191): n is a, c, g, or t
  modified_base (273)..(273): a, c, t, g, unknown or other
  misc_feature (273)..(273): n is a, c, g, or t
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
  modified_base (384)..(384): a, c, t, g, unknown or other
  misc_feature (384)..(384): n is a, c, g, or t
  modified_base (389)..(389): a, c, t, g, unknown or other
  misc_feature (389)..(389): n is a, c, g, or t
  modified_base (440)..(440): a, c, t, g, unknown or other
  misc_feature (440)..(440): n is a, c, g, or t
  modified_base (460)..(460): a, c, t, g, unknown or other
  misc_feature (460)..(460): n is a, c, g, or t
  modified_base (527)..(527): a, c, t, g, unknown or other
  misc_feature (527)..(527): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtncagctggtggagtcgtggggggagcgtggtccagcctgggacgtccctgagctctcctgtgcaggctctgctacttccctanaataactatgctatcgtagttcgggtccncaggctccgaggcgaagggctgggaggtgggtgacaagtatcgtnagtntgatgggaagctaaacgtaaatgtacgctaagnttcgngcggaggggcattccacatactaccagaacgaccaactaccaagatagtanatataactctaaacaaatanaaacgtacgacctaggaacgtaaccgtaggaacggacgaacggtcttaaggttaattacgtttacgnggtacggtcggtacgggacggggttactcggttcgtccgg

SEQ ID NO: 354034 - DNA, 721 bp, Homo sapiens
  misc_feature: GZ8MTXP01AW915.52.76.G10.1.454.CMB.2.raw
  modified_base (419)..(419): a, c, t, g, unknown or other
  misc_feature (419)..(419): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtcctcgtacggtaaccaacaaccgtaccccggactaaaccgtccccaaatccatgacttcgtttagagtcagtgacgtccggcccgtaggtacgggtttccacgtcttccggtcttccgtccggtccctacccgtagtcgtagggccaacggccgccggtccctcccggtnaaccctgttcctcgtacgggccttaccggaggtcctagggacggaccggtagggtccttaggtaactttaacgttacccggtcgtactaccgtaccgtaactaaaccgtaaaccaaaacgaaaacgtaaccggtaaccggttacgggttcggggtaccggtacccggggacccgggtaaccggtaaaccctaacgtcccggttaaccccgtacgttacggtacccgacccgacccgttacggttccccgtaaccccggtccccgtcgttacctaccgttcccgttcccgttcccctaacccg

SEQ ID NO: 354035 - DNA, 564 bp, Homo sapiens
  misc_feature: GZ8MTXP01A7LZH.52.76.G10.1.454.CMB.2.raw
  modified_base (177)..(177): a, c, t, g, unknown or other
  misc_feature (177)..(177): n is a, c, g, or t
  modified_base (236)..(236): a, c, t, g, unknown or other
  misc_feature (236)..(236): n is a, c, g, or t
  modified_base (299)..(299): a, c, t, g, unknown or other
  misc_feature (299)..(299): n is a, c, g, or t
  modified_base (388)..(388): a, c, t, g, unknown or other
  misc_feature (388)..(388): n is a, c, g, or t
  modified_base (477)..(477): a, c, t, g, unknown or other
  misc_feature (477)..(477): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtntccagtgtcaggtgcagctggtggagtctgggggagcgtggtccagcctgggagtcccngagactctcctgtgcaggctctgctacttccctacaatactatgctagtcgagttgggtcccncgaggcctccgagggcaagggctgggaggtggggtgacagtaatctcgagctgactgggagcaaactaaatattacgcaggatttccgngtacggagggggtcctattccactaactactaccagacgaactaactacccaagtatatagaatataactactaacaaagtacgaaacncgacctggactaaccgtggacggacgttaccggataggttaattgttaccgtgtacggtccgtgggacggggctaaggttcgcccgg

SEQ ID NO: 354036 - DNA, 611 bp, Homo sapiens
  misc_feature: GZ8MTXP01AOD9I.52.76.G10.1.454.CMB.2.raw
  modified_base (274)..(274): a, c, t, g, unknown or other
  misc_feature (274)..(274): n is a, c, g, or t
  modified_base (415)..(415): a, c, t, g, unknown or other
  misc_feature (415)..(415): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggagcgtggtccaggcctgggacggtccctgagactctcctgtgcaggctctgctattcccctnaataactatgctatcgagtttcgggtcccgccagggcctaccgagggacaaagggggtctggggaggttgggggtcggacaaggtaactatcagctgagtgggaacgctaaactaaaagtattacggctagtaatttccgnggacggaggggggtacccctattacaaccctaatacttacccgaagaacgaaccaaacctacccaaaggtaagtaattggaaattacttaatcttaaacaaattacgaaacagtaccctgaacggtcctaggaacggacgacgggtactgttaattacttacgtgtgcggtcggagggggctaagttcgtaacccg

SEQ ID NO: 354037 - DNA, 535 bp, Homo sapiens
  misc_feature: GZ8MTXP01ARDQN.52.76.G10.1.454.CMB.2.raw
  modified_base (224)..(224): a, c, t, g, unknown or other
  misc_feature (224)..(224): n is a, c, g, or t
  modified_base (362)..(362): a, c, t, g, unknown or other
  misc_feature (362)..(362): n is a, c, g, or t
  modified_base (430)..(430): a, c, t, g, unknown or other
  misc_feature (430)..(430): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttgtacttataactctgtctctggtaccaacaactaccccggacaaacgtccccaaactcatgatcttgaggtcagtgatcggcccgctaggggtttctcatcgcttccgtccggctccaagtctggcngcacggcctcctgacatctcgtggctcgagctgaggcgaggctagacttatactgcagctcataccanaaacagaaaactgttgggtagttcggcgggaacgggtaaccaaacgtcgaccgtccttacgccgaggcccaaggtctccgcccctcggcctaaccgttcttcccg

SEQ ID NO: 354038 - DNA, 763 bp, Homo sapiens
  misc_feature: GZ8MTXP01EWK4O.52.76.G10.1.454.CMB.2.raw
  modified_base (274)..(274): a, c, t, g, unknown or other
  misc_feature (274)..(274): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtcgtgggtcctcctggacagtcgatcaccatctctgcactggaaccagacaagtgtacgttagtacttatactctgtctctgtaccaacacaccccganaaacgtcccaaatcatgattcgttagagtcagtgacgtccggccccgtgtacggggtttctacgtagttccgtcctttccgtcccggtccctaccgtaaaggttccgtaggccgaaaccggcccgtaacccgggtcccctacccggtacgacccgtacttccgtcggttcggggacccttccggaacggcgtacgggaacgggtacgaacgggtcttagtaacgttacttacgcgactacggtacctaacgtaaacttaaaccaaaacgaaaaccgtaagtaaaaccggtttcgggttttacgggggtaccggttaccggggaacccgggggaacccgtaaacccgtaaaaccggttccggttaacccggttacccgttaaccgtaccggaaacccggaccccggttaacggttccccgtcccccggtcccccgttcgggttaccctacccttccccggtttaacccgttaaccccccgtttaaccccg

SEQ ID NO: 354039 - DNA, 621 bp, Homo sapiens
  misc_feature: GZ8MTXP01BLY6J.52.76.G10.1.454.CMB.2.raw
  modified_base (287)..(287): a, c, t, g, unknown or other
  misc_feature (287)..(287): n is a, c, g, or t
  modified_base (320)..(320): a, c, t, g, unknown or other
  misc_feature (320)..(320): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttctttaagaggtgtccagtgtcaggtgcagcgtggtggagtcgtggggggaggcgtggtccaggccgtggggacggtccctgacgactctcctggtcgcaggtcctcgtgcctacttcccctanaattaactatgctagtcgtagttcggggtcccnccgagggccctaccgaagggaccgaagggggtactgggggaggtgggggtacgacgtaaggtaatacgtcgaagtcgtaggagtgggaacgctaaacttaaaagtgttacgactaagtagttcgtaggcggacgggtcgtacttaccaactagtactaccagaacgacaactaccaagtatatagtatatactactaacaaatagaactacgacctagaacgtaaccgtagacggacacgggtctagttaacgttcttacgtggtcggtcggtcgggagggggctaacggttcggaaccgg

SEQ ID NO: 354040 - DNA, 580 bp, Homo sapiens
  misc_feature: GZ8MTXP01EAU2U.52.76.G10.1.454.CMB.2.raw
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctggggttctcctcgttgttcttttaagaggtgtccagtgtcaggtgcagctggtggagtcgtgggggaggcgtggtccagcctgggaggtccctgagactctcctgtgcaggctctgctattccctanaataactatgctatcgattcgggtccnccaggcctccgaggcaagggctggagtggtgcagtaatctcagctgagtagggagctaacgtaaatacttacgcagtattcgtgcggtaggggccgtattaccacctaatactaccgagaacgacaacctaccaagataatagaatataatctaaactaatacgaactacgacctacgagtaaccgtggaacggacgttaaccggtacgttaggttaattacgtttaaccgtggttacggcggttaccggaggggggacctaagggttcgtaacccggg

SEQ ID NO: 354041 - DNA, 530 bp, Homo sapiens
  misc_feature: GZ8MTXP01E0EV8.52.76.G10.1.454.CMB.2.raw
  modified_base (361)..(361): a, c, t, g, unknown or other
  misc_feature (361)..(361): n is a, c, g, or t
  modified_base (370)..(370): a, c, t, g, unknown or other
  misc_feature (370)..(370): n is a, c, g, or t
  modified_base (498)..(498): a, c, t, g, unknown or other
  misc_feature (498)..(498): n is a, c, g, or t
tcagcgcagtacgacacgaccggtgctcgatttagtcactcatacagggcacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcaatgacgttggtacttataactctgtctcctggtaccaacatacccccggcaaacgtcccccaaactcatgatctttgacggtcagtgatcggcccgcnggggtttcncatcgcttctccggctccaagtctggcagcaccggcctccctgacccatcctcgtgggcctccgaggcctggacggacgaggctgattatactgcaagcttcattacacaaacagaaacacgttgggnttcgggcggcgggaccaaacgttgtaaccccg

SEQ ID NO: 354042 - DNA, 707 bp, Homo sapiens
  misc_feature: GZ8MTXP01CNFSQ.52.76.G10.1.454.CMB.2.raw
  modified_base (247)..(247): a, c, t, g, unknown or other
  misc_feature (247)..(247): n is a, c, g, or t
tcagcgcagtacgacacgaccggtgctcgatttagtcactcatacagggcacgaccggtgctcgatttagtcactcatacaggggggctggggtctcaggaggcagcgctcgtcgggacgtctccaccatggcctgggctctgctattcctcaccctcctcactcgagggcacgagggtcctgggcccagtctcgccctgactcagcctgcctcgtgtcgtggtcctcctggacagtcgatccaccntcctcctgcactagaaccagcaatgtacgttgtaacttataactctgtctcctcgtaaccaacaaccgtaccccgacaaaccgtaccccaaactcatgtacttcgttgacgtacagtgacgtccggacccggtcgtaacggggtttctacgtacgttccgtccgtttccgtacccgggtaccctccgtaagttcccgtacgggaccacggacccgaccgggtccccttaccccgtacggtaacccctacgttcccgtcgttccgggtccgttacccggagggtccgtaggacggtaccggtacggtcgttacggttaactttacgttaccgttacgccggtaacgtccttacaacttaaaccaaacgtaaacgttaaacgttaaaccgttaccgggtttgggtaccgggttccgggaccggggtaccggttaaaccctaacggttaaccgttaaccccgg

SEQ ID NO: 354043 - DNA, 682 bp, Homo sapiens
  misc_feature: GZ8MTXP01BCE5Y.52.76.G10.1.454.CMB.2.raw
  modified_base (436)..(436): a, c, t, g, unknown or other
  misc_feature (436)..(436): n is a, c, g, or t
  modified_base (467)..(467): a, c, t, g, unknown or other
  misc_feature (467)..(467): n is a, c, g, or t
  modified_base (471)..(471): a, c, t, g, unknown or other
  misc_feature (471)..(471): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcacgtggaaccagcaatgacgttggtacttataactcttgtctcctcgtaccaacaactaccccggacaaacgtccccaaactcatgattctttggagtcagtgacgtccggaccgcgtacgggtttctcgtactcgtcttcgtcccggtcctaccgtagtcgtcggcaacgccgaaccgggtccctcccgtacgaccctatccgtcgtcgggtcctcgaggtcgnggaaggaccgaggtcttagtattacttacgngacncgtctacataaaccaactaaaaccgagtaaaccgtacggtttcggggtacgttccgggggaccgggaaccggtaacccgtaaacggtccggttaccccggttacccgttacggtacccgtaacggccccggttaaacgttcccggtaaccccgtcccccggttaacgggttcccctaccgttcccgttccccggttcccccccgttccccg

SEQ ID NO: 354044 - DNA, 693 bp, Homo sapiens
  misc_feature: GZ8MTXP01BR3BV.52.76.G10.1.454.CMB.2.raw
  modified_base (252)..(252): a, c, t, g, unknown or other
  misc_feature (252)..(252): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatccaccatcctcctgcacgtggaaccagacaagtgtacgttgtacttataactntgtctctgtacaacacacccgacaacgtcccaaatcatgtatctttgagtcagtgacgtcggcccgtagtacggggtttctcgacttccgtcttcgtcccggtcctaccgtaagtcgtcggcaacgcctcggccctcccgtcgaccctatccgtcgtcgggcctcgacggtctagggacggacggaacggtgttacgttatttaacgttcgtagacgtacgtactactaattaaaccaacgtaaaaccgtaacggtaaaccgttacgggtttacggggtacggttcccggggacgggtaacccgggtaaacctaaacccgggtacgttaccccggtaccgttaaccggttacccgtaaccgccccgaacgggttcccctccccgggcccccgtttaacggtccctaccccgttccgttccccggtttcccccgttcccccg

SEQ ID NO: 354045 - DNA, 616 bp, Homo sapiens
  misc_feature: GZ8MTXP01A5DSN.52.76.G10.1.454.CMB.2.raw
  modified_base (191)..(191): a, c, t, g, unknown or other
  misc_feature (191)..(191): n is a, c, g, or t
  modified_base (201)..(201): a, c, t, g, unknown or other
  misc_feature (201)..(201): n is a, c, g, or t
  modified_base (218)..(218): a, c, t, g, unknown or other
  misc_feature (218)..(218): n is a, c, g, or t
  modified_base (273)..(273): a, c, t, g, unknown or other
  misc_feature (273)..(273): n is a, c, g, or t
  modified_base (318)..(318): a, c, t, g, unknown or other
  misc_feature (318)..(318): n is a, c, g, or t
  modified_base (329)..(329): a, c, t, g, unknown or other
  misc_feature (329)..(329): n is a, c, g, or t
  modified_base (443)..(443): a, c, t, g, unknown or other
  misc_feature (443)..(443): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacngtcgatcacntctctgcactggaaccngcaagtgtacgttgtacttataactctgtctcgtgtaaccacaactaccccgganaaacgtcccaaatcatgatcgtttgagtcagtcgagtccggccgngtcgggtttcncgtattcgcttacgccggtctaccagttcgagccaaagccctccggccctccgtacgacctgtccgtcgtcggctcgaggtcgtggaacggcgtacgctaggtacttactacgngacacgcttacaactaacgaaacaaacgaacgtaacgtagttcgggtcgtaccggcggtaaccgacgtaaactccggttaccgttccgttacgaacgccggaccgttacgggttccctaacccggtcccccgtcggttacctcccgttcccgttcccggttccccgtaacccg

SEQ ID NO: 354046 - DNA, 824 bp, Homo sapiens
  misc_feature: GZ8MTXP01DJGNO.52.76.G10.1.454.CMB.2.raw
  modified_base (253)..(253): a, c, t, g, unknown or other
  misc_feature (253)..(253): n is a, c, g, or t
  modified_base (307)..(307): a, c, t, g, unknown or other
  misc_feature (307)..(307): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggagcgtggtccagccgtgggagtcctgagactctcctgtgcnggctctgctacttcccctataaataactatcgacttatcgtagttcgggtcccnccgaggccctacgaagggacgaaggggtcgtgggaggtggggtaggactaaaggtaatactcgaaggtcgtaggagtacggggaacggtaacctaaacttaaaacgttacgtttaaaccggactaaggttaacgtttccggttacggggaccggggtaaacggggggtcccctaaactttacccgaaaaccctaagtttaaacctaccccgaaagggaaacttaaaaccccaaaccccgttaaccccgaaaaaggttaacgtttaaacgttacggtaaaattttaaacgttaaacttaaaccccggttaaaaactaaaaggttaaccgggaaaaccctaacgggtttaccccgtaggggaaacccgtaacccggggttaagggaaaccggggtaaccgttaaaccgggggtttactttaacgggttttaaaagtttacgtttaaacccgttgggggtttacgccccggggttaacgggggaggggggttaccttaacgggttccgggttccccgggg

SEQ ID NO: 354047 - DNA, 709 bp, Homo sapiens
  misc_feature: GZ8MTXP01A2T04.52.76.G10.1.454.CMB.2.raw
  modified_base (190)..(190): a, c, t, g, unknown or other
  misc_feature (190)..(190): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctcgtgtctgggtctctggacngtcgatcacatctcctgcactggaaccagcaatgacgttgtacttatactctgtctcctaggtaccaacaacaccccggacaacgtacccaaactcgatgtattcgtttagaggtcaggtgacgtccggaccgtcgtacggggtttctcgtacttccgtccttccgtccggtcctaccgtaagtcgtcggacgaaccgccgtaaccggccctaccgtacgtaccctacgttccgtcgtcgggcctccgaggccgtagggacgggacgtacggtacgttagttaaacgtttacgttacgtacgacgtaacgtcgttaacgtaacgttaaaccaaacctaaaacgtaacgtaaaaccgttcggtttaacgggggttcggttaccgggggaccgggtaccgggtaaacccgtaaacgtcggttacccgttaccgttaacggtaccgaaccggttacccgaacgggttcccgtcccgtaccccgttcgtaccgtcgttcccggtcccttaaccccgtaacccc

SEQ ID NO: 354048 - DNA, 623 bp, Homo sapiens
  misc_feature: GZ8MTXP01C1Q24.52.76.G10.1.454.CMB.2.raw
  modified_base (245)..(245): a, c, t, g, unknown or other
  misc_feature (245)..(245): n is a, c, g, or t
  modified_base (271)..(271): a, c, t, g, unknown or other
  misc_feature (271)..(271): n is a, c, g, or t
  modified_base (299)..(299): a, c, t, g, unknown or other
  misc_feature (299)..(299): n is a, c, g, or t
  modified_base (344)..(344): a, c, t, g, unknown or other
  misc_feature (344)..(344): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggagcgtggtccagcctgggaggtccctgagactcncctgtgcaggctctgcattcccctanaataactatgctatcgtagttcgggccncaggcctcgaggacgaagggctggaggtgggtgacaagtaatacncagctgatagggagctaaataaatacttacgactagtactttcgtggacggtacgggggaccctattaccaaccctaagttactacccgaaggaaacgaacctaaaccgtacccgaaagtaacgttaagtagtaaattaacgtaataacctaaacgtaaaagtacgaaactaggtaccctagaacggtaacctagggaaacggaccgttacggtcgttaagttaatttacgttacgtgggtcgtccgggtacgggacggggacggtaacggttcggtcg

SEQ ID NO: 354049 - DNA, 647 bp, Homo sapiens
  misc_feature: GZ8MTXP01DIDO3.52.76.G10.1.454.CMB.2.raw
  modified_base (283)..(283): a, c, t, g, unknown or other
  misc_feature (283)..(283): n is a, c, g, or t
  modified_base (315)..(315): a, c, t, g, unknown or other
  misc_feature (315)..(315): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagcgtggtggagtcgtgggggaggcgtggtccagccgtgggaggtccctgagactctccgtggtcgcgaggtctctcgctacttcccctanaaattaactatgctagtcgagtttcgggcccnccgacggcctcgaggacgaaggggtctgggaggtgggtaggacgagtaatacgtcgagcgtagagaagggagaactaaactaaagttactacgactagtacgttcgtaggcggacggggtacctactccgaaaccaagtacctacgaagtaaccaacctaaccgtacccaaagtaagttactaagtaaattactaaattactaaactaaagtaacgaacgtaactacccgtacggaacggtaaccctagggaacggtacgaacggttctaagttacttagttaccgttaagggtcgtcggtacgggacggggctaacggttcggtaaccggg

SEQ ID NO: 354050 - DNA, 630 bp, Homo sapiens
  misc_feature: GZ8MTXP01DBL9K.52.76.G10.1.454.CMB.2.raw
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
  modified_base (496)..(496): a, c, t, g, unknown or other
  misc_feature (496)..(496): n is a, c, g, or t
  modified_base (513)..(513): a, c, t, g, unknown or other
  misc_feature (513)..(513): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgccttcgtgtctgggtctccgtggacngtcgatcaccntctctgcactggaaaccngacaatgacgttgtaacttataactctgtctctagtaccaacaacaccccgacaaacgtcccaaactcgatgtacttcgtttagacgtcagtcgacgttccggcccgtcggttaacgggggttttcactacgttccgtccgtttcctccgggtccccttaccgaagttccgtgaccgaaacgccgaacccggtccctacccttaggaaccctacgtcgtcgtcgggtcctcgaggtccgtagggacggacggaggcttagtaagtttacttacngacagtctaatactaanaaacaaagagtaaacgtggttagggtcgtcgggacggaccgtaaacaacgtcgaccgtacacggtacacgttccgacgcctccgcccctcggcctacgttccttccgttccctaacc

SEQ ID NO: 354051 - DNA, 698 bp, Homo sapiens
  misc_feature: GZ8MTXP01DY45J.52.76.G10.1.454.CMB.2.raw
  modified_base (278)..(278): a, c, t, g, unknown or other
  misc_feature (278)..(278): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtcagtgtcaggtgcagcgtggtggagtcgtgggggaggcgtggtccagccgtgggacggtcccgtgagactctcctggtgcaggctctgctacttccctanaataactatgctagtcgtagttcgggtccgaccgaggcctacgaggacgaagggtcgtggaggtgggtcgactaaaggtaatactcgagcgtagagtaacgggagaactaaacgtaaaagttacgttaacgacgtaaggtactttacggacgggacgggacgggggtcctaattcccaaccgtaattacaccgaagaaacacctaaaccgccaaaagtattaaagtacgtaaatttaactaacttaaacccgtaaaactaaagttacgaaaacgtacgtaccgtaacggtaaacggaacccggttaggaaccgggtaaaccgttaccgggttaactttaaggttaaagttttacccgttaagtcgggttaccgcgggttaacggggacgggggttacttaacggggttcgtaaccccggg

SEQ ID NO: 354052 - DNA, 572 bp, Homo sapiens
  misc_feature: GZ8MTXP01EPKI6.52.76.G10.1.454.CMB.2.raw
  modified_base (276)..(276): a, c, t, g, unknown or other
  misc_feature (276)..(276): n is a, c, g, or t
  modified_base (339)..(339): a, c, t, g, unknown or other
  misc_feature (339)..(339): n is a, c, g, or t
  modified_base (368)..(368): a, c, t, g, unknown or other
  misc_feature (368)..(368): n is a, c, g, or t
tcagcgcagtacgacacgaccggtgctcgatttagtcactcatacaggggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctgggtggagtcgtgggggaggcgtggtccagccgtggggagtccctgagactctcctgtgcaggctctgctattcccctnaataactatcgactatcgtattgggtcccgcaggctcaggcagggctggagtgggtgcagtanatcagcgtgagtgggagcaaacgtaaatnttaacgcaggtattcgtgacggacggggcgtatccgacctatactacagaacgaccaactacccaagatatagtataactatactaactaaagtacgaactagaccctgaacgtaaccgtaggacggaccgttacggacttaattaattactttaacgtgggtcgtaacggtcgggtacgggggacctaagggttcgtcccggg

SEQ ID NO: 354053 - DNA, 642 bp, Homo sapiens
  misc_feature: GZ8MTXP01DL2CM.52.76.G10.1.454.CMB.2.raw
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (276)..(276): a, c, t, g, unknown or other
  misc_feature (276)..(276): n is a, c, g, or t
  modified_base (292)..(292): a, c, t, g, unknown or other
  misc_feature (292)..(292): n is a, c, g, or t
  modified_base (330)..(330): a, c, t, g, unknown or other
  misc_feature (330)..(330): n is a, c, g, or t
tcagcgcagtacgacacgaccggtgctcgatttagtcactcatacaggggggctggggtctcaggaggcagcgctctcgggacgtctccaccatggcctgggctctgctattcctcaccctcctcactcagggcacagggtcctgggcccagtctgccctgactcagcctgcctccgtgtcgtggtctcctggacngtcgatcaccatcctctgcactggaaccngacaatggtacgttgtaacttatactctgtctctagacaacaacacccganaacgtcccaaatcatnatcttgagtcagtcgactccggcccgtgtagggtttcncgacttcgtcctttccgccggtactacgaagtcctaggcaacgcgacccggtccctacccgacgacctatccgtcgtcgggcctaccgaggtcctagggaacgggtaccgagggtaccgttagtaacgtttactacgtcgacggtactacctacctaataaaccaaacaaacgaaacgtaaaaccgtggttacggggtcgtaaccggggcggaaccgggtaaaccttaacggtccgaacccgttaccgtacgaccgacgacccgtaacgcctcccggtaccccgtcgttacctaaccgttcccgttccccgg

SEQ ID NO: 354054 - DNA, 526 bp, Homo sapiens
  misc_feature: GZ8MTXP01AI5U8.52.76.G10.1.454.CMB.2.raw
  modified_base (257)..(257): a, c, t, g, unknown or other
  misc_feature (257)..(257): n is a, c, g, or t
  modified_base (270)..(270): a, c, t, g, unknown or other
  misc_feature (270)..(270): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
  modified_base (386)..(386): a, c, t, g, unknown or other
  misc_feature (386)..(386): n is a, c, g, or t
  modified_base (459)..(459): a, c, t, g, unknown or other
  misc_feature (459)..(459): n is a, c, g, or t
tcagcgcagtacgacacgaccggtgctcgatttagtcactcatacagggggctctgggagacgagcccagcactggaagtcgccggtgtttccattcggtgatcatcactgaacacagagactcaccatggagtttggcagagctgggttctcctcgttgttcttttaagaggtgtccagtgtcaggtgcagctggtggagtctgggggagcgtggtccagcctgggaggtccctgagactctcctgtgcaggctcngcattcccctaanaataactatgctatcgagttcgggtcccgcgaggcctacgaggacgaagggctgggaggtgggtgacaagtaatacncagntgatgggagctaaataaatntacgnagtacttcgngcggagggactatacactatacacagaacaacaacacaaagaagtaatataataataatactaaataaataanaacacacacgagaactagagacgacgacgtagttattacttacgtgtgcgcgagggacgtcgcgtcg

SEQ ID NO: 354055 - DNA, 582 bp, Homo sapiens
  misc_feature: GZ8MTXP02IVM5Q.52.76.G10.1.454.CMB.2.raw
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
  modified_base (398)..(398): a, c, t, g, unknown or other
  misc_feature (398)..(398): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctggggttctcctcgttgttcttttaagaggtgtccagtgtcaggtgcagctggtggagtctgggggagcgtggtccagcctgggaggtccctgagactctctgtgcaggctctgcatttccccttanaataactatgctatcgagttcgggtccnccaggcctccgaggacgaagggctgggaggtggggtgctaagtaatactcagctagagtgggaagctaaacttaaaatagttaccgacagtattcgnggacggacgggacgactacacatactacagaacgacaactaccaaacgaataatagtataataataactaactaaataacgaaacaacgacgtacgaacgaaccgtacgaacggaacgaacggacgtaactaacttaattaacgtaagtcgtacggtacggacggggacggtacggtacggtcg

SEQ ID NO: 354056 - DNA, 504 bp, Homo sapiens
  misc_feature: GZ8MTXP02IA9GN.52.76.G10.1.454.CMB.2.raw
  modified_base (340)..(340): a, c, t, g, unknown or other
  misc_feature (340)..(340): n is a, c, g, or t
  modified_base (350)..(350): a, c, t, g, unknown or other
  misc_feature (350)..(350): n is a, c, g, or t
  modified_base (444)..(444): a, c, t, g, unknown or other
  misc_feature (444)..(444): n is a, c, g, or t
tcagcgcagtacgacacgaccggtgctcgatttagtcactcatacagggcacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaccagcaatgactggtacttataactctgtctcctggtaccaacaataccccgcaaagtcccaaactcatgatctttgagtcagtnatcgcccgcnggggttctcatcgcttctcgctccagtctggcagcacggcctccctgacccatctctcgggctccgaggcctgaggcgagcgtgattatatgcngactcatacacaaacacgaaacacgtggtagttcggacggaccggacaaacgtcgacccg

SEQ ID NO: 354057 - DNA, 537 bp, Homo sapiens
  misc_feature: GZ8MTXP02IORAD.52.76.G10.1.454.CMB.2.raw
  modified_base (359)..(359): a, c, t, g, unknown or other
  misc_feature (359)..(359): n is a, c, g, or t
  modified_base (439)..(439): a, c, t, g, unknown or other
  misc_feature (439)..(439): n is a, c, g, or t
  modified_base (518)..(518): a, c, t, g, unknown or other
  misc_feature (518)..(518): n is a, c, g, or t
tcagcgcagtacgacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccagcaatgacgttgtacttataactctgtctctggtaccaacaataccccggcaaacgtccccaaaactcatgaatctttgaggttcagtgatcggcccgcaggggtttctcatcgctctccggcctcagtctggcagcnccggcctccctcgaccactctcttcgggcctccaggctggaggacgagctgtattactactgcagctcatacacaaacanaaactacgtggtgttcggacggcggaaccaacgtcgtaccgtcctacgcacgacccaaggctccgccccgtcggtaccnctcgtccgttcccgtcccc

SEQ ID NO: 354058 - DNA, 524 bp, Homo sapiens
  misc_feature: GZ8MTXP02GVR9S.52.76.G10.1.454.CMB.2.raw
  modified_base (329)..(329): a, c, t, g, unknown or other
  misc_feature (329)..(329): n is a, c, g, or t
  modified_base (354)..(354): a, c, t, g, unknown or other
  misc_feature (354)..(354): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttatactctgtctcctggtaccaacaataccccggcaaagtccccaaactcatgatctttgagtcagtgatcggcccgcaggggtttcncatcgcttcctcgctcagtctggcngcacggcctccctgaccatctctgggctcaggctgagacgagctgattagtactgcagctcatacacaaacagaaactacttgggtgttcgggacggtaccggaaccaaacgtcgacccgtcctacgtacacgcccgaaggcctcggaccccctggtccacgtcttcccg

SEQ ID NO: 354059 - DNA, 548 bp, Homo sapiens
  misc_feature: GZ8MTXP02I0LRM.52.76.G10.1.454.CMB.2.raw
  modified_base (360)..(360): a, c, t, g, unknown or other
  misc_feature (360)..(360): n is a, c, g, or t
  modified_base (379)..(379): a, c, t, g, unknown or other
  misc_feature (379)..(379): n is a, c, g, or t
tcagcgcagtacgacacgaccggtgctcgatttagtcactcatacagggcacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgacgttggtacttataactctgtctctggtaccaacaactaccccggcaaaacgtccccaaactcaatgatctttgagtcagtgatcggcccgcnggggtttctcatcgcttcnccggctcagtctgcagcacggcctcctgacccatctcgtcgggcctccgaggctggaggaccgaggctggtattattactgacacgctacactaacaactaaacaacgaaactaccgttaagggtcgttacgggaccggaccgggtaacccaaacgtacggtaaccccg

SEQ ID NO: 354060 - DNA, 521 bp, Homo sapiens
  misc_feature: GZ8MTXP02F3KIM.52.76.G10.1.454.CMB.2.raw
  modified_base (356)..(356): a, c, t, g, unknown or other
  misc_feature (356)..(356): n is a, c, g, or t
tcagcgcagtacgacacgaccggtgctcgatttagtcactcatacaggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgaggtcagtgatcggcccgcaggggtttctcatcgcttctccggcctcagtctggcagcncggcctccctgccatctctgggctccaggctgaggacgaggctgattattactgcagctcatacacaaacagaaacacgttgggtgttcggcggcggggaccaaaacgtcgaccgtctacgtcacgcccaaggctcgccccctcggtcacctctcgtcccgtccc

SEQ ID NO: 354061 - DNA, 619 bp, Homo sapiens
  misc_feature: GZ8MTXP02JR4Q2.52.76.G10.1.454.CMB.2.raw
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggagcgtggtccagcctgggagtccctgagactctcctgtgcaggctctgctactttccctacaataactatgactatcgagttcgggtccgccaggcctccgaggccgaagggctggaggtgggtgcaagtatactcgagctggatgggagactaaacgtaaatagttaccgatagtattcggaggacggacggggccctattacccaactagttaccaccgaaggaacaaacccaaaccttacccgaaagtaacttaggtacgtaaattattaaactaccctaaaaataaacgtacgaaacgtaccgtacgtaaggaaccgtaccggtagggaaacggtaccgacggttactaagttacttaacgttcgtggacggtacggacgggagggtcctaggtccggtaccg

SEQ ID NO: 354062 - DNA, 609 bp, Homo sapiens
  misc_feature: GZ8MTXP02HSYMI.52.76.G10.1.454.CMB.2.raw
  modified_base (242)..(242): a, c, t, g, unknown or other
  misc_feature (242)..(242): n is a, c, g, or t
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
  modified_base (362)..(362): a, c, t, g, unknown or other
  misc_feature (362)..(362): n is a, c, g, or t
tcagcgcagtacgacacgaccggtgctcgatttagtcactcatacagggcacgaccggtgctcgatttagtcactcatacagggggctggggtctcaggaggcagcgctctcgggactcctccaccatggcctgggctctgctattcctcaccctcctcactcagggcacgagggtcctgggcccagtctcgccctgactcagcctgcctcgtgtcgtgggtctccgtggacagtcatcacntctctgcactggacagcaatgacgttgtacttatactctntctcctaggtacccaanacctaccccggacaaacgtccccaaactccatgtatcgtttagacgtcagtgagtccggccgngtcggggtttctacacgtccgtcttcgccgtctacctagtcgtgcagccacggccctccgtcgacctctcctcgtcggtacctcgaggtctagggacggacgacggtactaggttactttacgttacgtcgacgtacgacctttacaacttaaccaaaacaaaacgtaacgaaaccgttacggttaagggttcggttaccggggacggaccggggtaaacctaaaccggtttaccggtaacccccgg

SEQ ID NO: 354063 - DNA, 574 bp, Homo sapiens
  misc_feature: GZ8MTXP02GYJYV.52.76.G10.1.454.CMB.2.raw
  modified_base (333)..(333): a, c, t, g, unknown or other
  misc_feature (333)..(333): n is a, c, g, or t
  modified_base (364)..(364): a, c, t, g, unknown or other
  misc_feature (364)..(364): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaactaccccggcaaacgtccccaaatcatgatctttgaggtcagtgatcggcccgcgaggggtttcncatcgtcttccctccggctccaagtctggcngccacggcctcccgtgacctatcctcgtgggcctccgaggcctggacggacggaggctaggattatactggcagctacatacaacaaaacagaaaactcgttagggtcgttcgggcggaccgggacctaaaaccgtcggtacccgtaccttacggccacgacccgaaggcctacccggcccccgtacggtcccaccgttcgtttccccgg

SEQ ID NO: 354064 - DNA, 555 bp, Homo sapiens
  misc_feature: GZ8MTXP02FORB9.52.76.G10.1.454.CMB.2.raw
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
  modified_base (455)..(455): a, c, t, g, unknown or other
  misc_feature (455)..(455): n is a, c, g, or t
  modified_base (466)..(466): a, c, t, g, unknown or other
  misc_feature (466)..(466): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggagcgtggtccagccgtgggagtccctgagactctcctgtgcaggctctgctatttccctnaatactatgctatcgatttcgggccncaggctccgaggcaagggctgggagtgggtgcaaggtatactcagctgatggagcaactaaatgttacgcaaggtattcgtgcggaggggcccattccgaacctatactccgaagagaaccaactacccaaagtatatagaattatatacctaaaanaatacgaaacncgaccgtagaaccgacgtaggaacggacgtacgacttacgtaacttacgttacgtgtacggacggtacgggagggtctacggtcgaccg

SEQ ID NO: 354065 - DNA, 530 bp, Homo sapiens
  misc_feature: GZ8MTXP02JYWO2.52.76.G10.1.454.CMB.2.raw
  modified_base (270)..(270): a, c, t, g, unknown or other
  misc_feature (270)..(270): n is a, c, g, or t
  modified_base (276)..(276): a, c, t, g, unknown or other
  misc_feature (276)..(276): n is a, c, g, or t
  modified_base (295)..(295): a, c, t, g, unknown or other
  misc_feature (295)..(295): n is a, c, g, or t
  modified_base (331)..(331): a, c, t, g, unknown or other
  misc_feature (331)..(331): n is a, c, g, or t
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
  modified_base (386)..(386): a, c, t, g, unknown or other
  misc_feature (386)..(386): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggagcgtggtccagcctgggaggtccctgagactctcctgtgcaggctctgcatttccctnataacntgctatcgattcgggtccncaggctccaggcaagggctggagtgggtgcagtaanatcagctgatggagcaactaaatntacgcagattcgngacgaggcatcacatacncagacacaacacaagatatgatatactactaagaaatacgaacgtacgtaccgtaagacgtaccgtaggaacggacgaccggtcttacgtaacttaagttacgtggtacgtacgtacgggtacggggactacggtccggtaccg

SEQ ID NO: 354066 - DNA, 502 bp, Homo sapiens
  misc_feature: GZ8MTXP02IN5P8.52.76.G10.1.454.CMB.2.raw
  modified_base (295)..(295): a, c, t, g, unknown or other
  misc_feature (295)..(295): n is a, c, g, or t
  modified_base (331)..(331): a, c, t, g, unknown or other
  misc_feature (331)..(331): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (438)..(438): a, c, t, g, unknown or other
  misc_feature (438)..(438): n is a, c, g, or t
  modified_base (474)..(474): a, c, t, g, unknown or other
  misc_feature (474)..(474): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttctttaagaggtgtccagtgtcaggtgcagctggtggagtctgggggaggcgtggtccagcctgggaggtccctgagactctcctgtgcaggctctgcatttccctcaatactatgctatcgattgggtccnccaggctccaggcaagggctggagtgggtgcagtanatcagctgatggagcactaaatnttacgcagattcngcgaggggccattccaacatactccagaagacaactcccaaagatatgatataactctaacaaatgaaacngacctgacgacctgaggacacggctgtaatattacngtcgacgtcggaaggggcaggtcgaccg

SEQ ID NO: 354067 - DNA, 508 bp, Homo sapiens
  misc_feature: GZ8MTXP02JDPUO.52.76.G10.1.454.CMB.2.raw
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (400)..(400): a, c, t, g, unknown or other
  misc_feature (400)..(400): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggagcgtggtccagcctgggaggtccctgagactctcctgtgcaggctctgcatttccctnaatactatgctatcgattggccncaggctccgaggcaagggctggagtgggtgcagtatatcagctgatggagcaataaatntacgnagattcgngcggaggctatcanatacncagacacactaccaanatatagatatatactaacgaatacgaacacgtactagacgacgtaggaacggacgacggactagtactacgtacgtgtcgtacggtcggaggggtctacggtcgtccg

SEQ ID NO: 354068 - DNA, 566 bp, Homo sapiens
  misc_feature: GZ8MTXP02JQI0T.52.76.G10.1.454.CMB.2.raw
  modified_base (303)..(303): a, c, t, g, unknown or other
  misc_feature (303)..(303): n is a, c, g, or t
  modified_base (389)..(389): a, c, t, g, unknown or other
  misc_feature (389)..(389): n is a, c, g, or t
  modified_base (461)..(461): a, c, t, g, unknown or other
  misc_feature (461)..(461): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctctggtaccaacaactaccccggcaaacgtccccaaactcatgatcttgngtcagtgatcggcccgcgtaggggtttctcgtatccgtcttcccgtccggcctccgaagtctggcagccacggccctccctgaccntcctcgtgggcctccgaggctggacggacgaggcctagtattagttactgcagctacataacaacaaacganaaacgcgttagggtcgttacggccgggacggaccgaaactccggaccgtacctacgtacgaacgcccgaaggcctaccggcccctcggtactccgtcttaccccg

SEQ ID NO: 354069 - DNA, 626 bp, Homo sapiens
  misc_feature: GZ8MTXP02I4KN8.52.76.G10.1.454.CMB.2.raw
  modified_base (227)..(227): a, c, t, g, unknown or other
  misc_feature (227)..(227): n is a, c, g, or t
  modified_base (236)..(236): a, c, t, g, unknown or other
  misc_feature (236)..(236): n is a, c, g, or t
  modified_base (253)..(253): a, c, t, g, unknown or other
  misc_feature (253)..(253): n is a, c, g, or t
  modified_base (431)..(431): a, c, t, g, unknown or other
  misc_feature (431)..(431): n is a, c, g, or t
tcagcgcagtacgacacgaccggtgctcgatttagtcactcatacagggcacgaccggtgctcgatttagtcactcatacagggggctgggtctcaggaggcagcgctctcgggactctccaccatggcctgggctctgctattcctcaccctcctcactcagggcacagggtcctgggcccagtctgccctgactcagcctgcctcgtgtctgggtctcctggacngtcatcacntcctctgcactggaccngcaatgacgtggtactataactctgtctctgtaccacaataccccggcaaacgtccccaaactcatgactcttgacgtcagtgactcggccgcgtggggttctcagtccgtcttcgtccggctcctaagtctggcacgcgaccggtccctcctcgacctatctcgtcgggccttccgnggccgtaggacggacgacgggtcctggtaatttaactaccgttgtaccgaacgggtcctttaccgaaacgttaaacccgaaactaaaaaccgaaacgtaaaacccgttaacggttcgggggttaccggtttaacggggtacccgggtaacccgggggaaaacccctaaacggttaccggtttaaaacccccgggg

SEQ ID NO: 354070 - DNA, 530 bp, Homo sapiens
  misc_feature: GZ8MTXP02F5NDH.52.76.G10.1.454.CMB.2.raw
  modified_base (360)..(360): a, c, t, g, unknown or other
  misc_feature (360)..(360): n is a, c, g, or t
  modified_base (435)..(435): a, c, t, g, unknown or other
  misc_feature (435)..(435): n is a, c, g, or t
  modified_base (437)..(437): a, c, t, g, unknown or other
  misc_feature (437)..(437): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgagtcagtgatcggcccgcaggggtttctcatcgcttccctccggctccaagtctggcngcacggcctccctgaccatctctgggcctccaggctgaggcgaggctgattattactgcagctcatacaacaaananaaacacgttggtgttcggcggacggaccaaacgtcgaccgtcctacgtccacgacccgaaggcctcggcccccgtcggtccaccgtcttcccg

SEQ ID NO: 354071 - DNA, 772 bp, Homo sapiens
  misc_feature: GZ8MTXP02GDBCV.52.76.G10.1.454.CMB.2.raw
  modified_base (273)..(273): a, c, t, g, unknown or other
  misc_feature (273)..(273): n is a, c, g, or t
  modified_base (300)..(300): a, c, t, g, unknown or other
  misc_feature (300)..(300): n is a, c, g, or t
  modified_base (584)..(585): a, c, t, g, unknown or other
  misc_feature (584)..(585): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggagcgtggtccagcctgggaggtccctgagactctcctgtgcaggctctgcatttcccctanaatactatgctatcgtagttcgggccncgaggtcctccgaggcgaagggtacgtgggaggtggggtcgactaaggttaatactacgagtctaggagtacgggaacgacctaaacgttaaaagttacgttaccgacgtaaggtacgtttccgtacggggaccggggtaacggggggtacccgtaaacgtttacccgaaacccgttaacgttaacccttaaccccggaaaagggtaaaacccgtaaaacccccgtaaaaccccgttaaacccccggtaaaaaggttaaaccgtttaaaacggtttaacgggtnnaaaccggtaaaaccggaaacccggttaaacggggtaaaccggggtaaacccgggtaaacccgggtaaccggttaacggtttaaaacgtttaaacgttttaaaccggtttaacgggtttacgggttaaccggggttaccggggtaaccggggggtaccggggtaaccggggttaccgggttacccggg

SEQ ID NO: 354072 - DNA, 547 bp, Homo sapiens
  misc_feature: GZ8MTXP02GBY9F.52.76.G10.1.454.CMB.2.raw
  modified_base (224)..(224): a, c, t, g, unknown or other
  misc_feature (224)..(224): n is a, c, g, or t
  modified_base (331)..(331): a, c, t, g, unknown or other
  misc_feature (331)..(331): n is a, c, g, or t
  modified_base (361)..(361): a, c, t, g, unknown or other
  misc_feature (361)..(361): n is a, c, g, or t
  modified_base (434)..(434): a, c, t, g, unknown or other
  misc_feature (434)..(434): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttggtacttataactctgtctctggtaccaacaataccccggcaaagtccccaaactcatgatctttgaggtcagtgatcggcccgcgaggggtttcncatcgtcttccctccggctcaagtctggcngcacggcctccctcgaccatctcttcgggccttccgaggctggaggacgaggctgatttattactgcagctanatacaacaaacagaaacacgttgggtacgtcggacggaccgggaacaaacgtcggaaccctccgtacgtacacgacccaaggctaccggcccctcggtcctactccgttcccg

SEQ ID NO: 354073 - DNA, 537 bp, Homo sapiens
  misc_feature: GZ8MTXP02I26U2.52.76.G10.1.454.CMB.2.raw
  modified_base (272)..(272): a, c, t, g, unknown or other
  misc_feature (272)..(272): n is a, c, g, or t
  modified_base (298)..(298): a, c, t, g, unknown or other
  misc_feature (298)..(298): n is a, c, g, or t
  modified_base (337)..(337): a, c, t, g, unknown or other
  misc_feature (337)..(337): n is a, c, g, or t
  modified_base (361)..(361): a, c, t, g, unknown or other
  misc_feature (361)..(361): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (444)..(444): a, c, t, g, unknown or other
  misc_feature (444)..(444): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttctttaagaggtgtccagtgtcaggtgcagctgggtggagtcgtgggggaggcgtggtccagccgtgggagtccctgagctctcctgtgcaggctctgctatttccctnaatactatgctatcgatttcgggccnccaggctccgaggcaagggctggagtgggtgcagtaatntcagctagatggagcaactaaatntacgnaagtattcngcggaggggccatcacatactcagacgaaccaactaccaaagtatagtagtataactaataccgtaaanaaatcgaaaactagccgtagacgtaccgtggaacggacgacggcttagtaattattacgtgtacgtcggtacggacgggggctaggtcgccgg

SEQ ID NO: 354074 - DNA, 500 bp, Homo sapiens
  misc_feature: GZ8MTXP02F16Y5.52.76.G10.1.454.CMB.2.raw
  modified_base (274)..(274): a, c, t, g, unknown or other
  misc_feature (274)..(274): n is a, c, g, or t
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
  modified_base (332)..(332): a, c, t, g, unknown or other
  misc_feature (332)..(332): n is a, c, g, or t
  modified_base (346)..(346): a, c, t, g, unknown or other
  misc_feature (346)..(346): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
  modified_base (378)..(379): a, c, t, g, unknown or other
  misc_feature (378)..(379): n is a, c, g, or t
  modified_base (387)..(388): a, c, t, g, unknown or other
  misc_feature (387)..(388): n is a, c, g, or t
  modified_base (395)..(397): a, c, t, g, unknown or other
  misc_feature (395)..(397): n is a, c, g, or t
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
  modified_base (415)..(415): a, c, t, g, unknown or other
  misc_feature (415)..(415): n is a, c, g, or t
tcagcgcagtacgacacgaccggtgctcgatttagtcactcatacagggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaaatgacgttggtacttataactctgtctcctggtaccaacaaataaccccggnaaaagtccccaaaactcaatganctttnaggtcatgatgcccgcaggggttctcatcnctctcggctccaanctggcancncgcncctcacatctcngctcngnngagagagnnatatatnnncncanacaacaaacaaanaaacacgtgtgtcggcgcggacgaaacacgacgtacctactacgacgaccgacgacgcgcccgtccgtaccactctcgtccgtcc

SEQ ID NO: 354075 - DNA, 647 bp, Homo sapiens
  misc_feature: GZ8MTXP02HOEOI.52.76.G10.1.454.CMB.2.raw
  modified_base (272)..(272): a, c, t, g, unknown or other
  misc_feature (272)..(272): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (297)..(297): a, c, t, g, unknown or other
  misc_feature (297)..(297): n is a, c, g, or t
  modified_base (408)..(408): a, c, t, g, unknown or other
  misc_feature (408)..(408): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggagcgtggtccagcctgggagtccctgagactctcctgtgcaggctctgcatttcccctanaatactntnctatcgtagtcggccncgaggcctacgaggacgaagggcgtgggaggtggggtcgactaagtaatacgtacgagtcgtaggagtgggaacgtactaaacttaaaatacgttacgactaagtattcgnggacgggacgggacctaacttaccaacctaatactaccgaaaggaacgaaacctaacctaaccgaaagtaacttaagtagaattaactaacttaacctaaaagtaaacgtacgaaacgaacgtaccgtaacgaacgtaaccgtacggaacggaaccgtaacggtacgtacgttaacgttaacgttacgttaacggtacggtacggtacgggtacggggtacggtacggtacggtaccgg

SEQ ID NO: 354076 - DNA, 543 bp, Homo sapiens
  misc_feature: GZ8MTXP02GMXYX.52.76.G10.1.454.CMB.2.raw
  modified_base (359)..(359): a, c, t, g, unknown or other
  misc_feature (359)..(359): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (429)..(429): a, c, t, g, unknown or other
  misc_feature (429)..(429): n is a, c, g, or t
tcagcgcagtacgacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataaactctgtctcctggtaccaacaataccccggcaaagtccccaaactcatgatctttgaggtcagtgatcggcccgcaggggtttctcatcgcttctccggctccaagtctggcagcncggcctccctgaccatctctggggctccaggcngagagagcnatatactgnancncatacaacaaacaanaaacacgttggtggttcggacggacggaaccgaaactacgaccgtacctacgtacgacgaccgaacgacgtccgtccccgtccggtaccgtacctccttccgttaccctacccc

SEQ ID NO: 354077 - DNA, 554 bp, Homo sapiens
  misc_feature: GZ8MTXP02JC7PU.52.76.G10.1.454.CMB.2.raw
  modified_base (224)..(224): a, c, t, g, unknown or other
  misc_feature (224)..(224): n is a, c, g, or t
  modified_base (388)..(388): a, c, t, g, unknown or other
  misc_feature (388)..(388): n is a, c, g, or t
  modified_base (404)..(404): a, c, t, g, unknown or other
  misc_feature (404)..(404): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttgtacttatactctgtctctgtaccaacaataccccggcaaacgtccccaaactcatgatctttgagtcagtgagtcggacccgcgtaggggtttctctacgtcgtcttccctccggctccaacgtctggcacgccacggccctcctcgaaccnctctctgggcctccgngctgagacgaggctgattattacgngcngctacacaacaacaaacgaacgtaacgtcggttaggtcggtcggacggaccggaaccaacgtcgaccgtaccgtacgacgaccgaccgaacgccgtaccgcccgtcgtcctacgtccgtccg

SEQ ID NO: 354078 - DNA, 570 bp, Homo sapiens
  misc_feature: GZ8MTXP02FZ9GS.52.76.G10.1.454.CMB.2.raw
  modified_base (219)..(219): a, c, t, g, unknown or other
  misc_feature (219)..(219): n is a, c, g, or t
  modified_base (327)..(327): a, c, t, g, unknown or other
  misc_feature (327)..(327): n is a, c, g, or t
  modified_base (380)..(380): a, c, t, g, unknown or other
  misc_feature (380)..(380): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
tcagcgcagtacgacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcatcaccatctcctgcactggaaccngcaatgacgttgtacttatactctgtctctggtaccaacactaccccgacaaacgtcccaaactcatgatctttgaggtcagtgagtccggccgtcgtaggggtttcncgtatcgcttcgtccggcctccaagtctcggcagccaccggcctcctagaccntctcgtcgggcctcgaggctaggacgacgagctagtacttnttacgngacatctacaacaacaaacaaaacaacgtaacgtcggttgggtacgtccgggacggaccggaactaacgtacgtaccctacgtacgtacgaccgaccgacgtcctaacccgtcccgtcgtacctacttccgtccgtcccgtcc

SEQ ID NO: 354079 - DNA, 551 bp, Homo sapiens
  misc_feature: GZ8MTXP02IVI77.52.76.G10.1.454.CMB.2.raw
  modified_base (239)..(239): a, c, t, g, unknown or other
  misc_feature (239)..(239): n is a, c, g, or t
  modified_base (317)..(317): a, c, t, g, unknown or other
  misc_feature (317)..(317): n is a, c, g, or t
  modified_base (358)..(358): a, c, t, g, unknown or other
  misc_feature (358)..(358): n is a, c, g, or t
  modified_base (368)..(368): a, c, t, g, unknown or other
  misc_feature (368)..(368): n is a, c, g, or t
  modified_base (532)..(532): a, c, t, g, unknown or other
  misc_feature (532)..(532): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcatggaaccagcaatgacgttggtacttanaactctgtctcctggtaccaacaactacccggacaaacgtccccaaactcatgatctttgaggtcagtgatcggccgngtaggggtttctcatcgtctctccggctccagtctgcagcncggcctcccngaccatctcgtcgggctccgaggctaggaggacgaggctagtattatactgcagtctacataacacaaaacagaaacacgttgggacgttcgggcggtacgggaacctaaaacgtcgtaaccgtccgtaacgtacgacgacccgaagctccgaccctcggtacncgtacttcgtaccctaccc

SEQ ID NO: 354080 - DNA, 544 bp, Homo sapiens
  misc_feature: GZ8MTXP02JT36J.52.76.G10.1.454.CMB.2.raw
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
  modified_base (366)..(366): a, c, t, g, unknown or other
  misc_feature (366)..(366): n is a, c, g, or t
  modified_base (391)..(391): a, c, t, g, unknown or other
  misc_feature (391)..(391): n is a, c, g, or t
  modified_base (421)..(421): a, c, t, g, unknown or other
  misc_feature (421)..(421): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggagcgtggtccagcctgggagtccctgagctctcctgtgcaggctctgctatttcccctanaataactatgctatcgattcgggtccnccaggcctccgaggcgaaggctggagtgggtgcagtatactcagctgatggagcaataaatctacgnagatctgcgagggcgatcacatacnccagacgaccaactacccaaagactagtanaatatatactaaacgtaaatacgaactagacctagaacgaccgtaggacggacgaaccggtctacgtaagttacgttaacgtggtacgtacggtaccggagggggtactacggtcggtaccgg

SEQ ID NO: 354081 - DNA, 625 bp, Homo sapiens
  misc_feature: GZ8MTXP02F9P51.52.76.G10.1.454.CMB.2.raw
  modified_base (329)..(329): a, c, t, g, unknown or other
  misc_feature (329)..(329): n is a, c, g, or t
  modified_base (355)..(355): a, c, t, g, unknown or other
  misc_feature (355)..(355): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctctggtaccaacaatacccggcaaacgtccccaaactcatgatctttgagtcagtgatcggcccgcaggggtttcncatcgctcctccggctcagtctggcngcacggcctccctgaccatctcgtcggctaccagccgtgaggaccgaggctagtacttattacgttggctacggctactaactaacaaaccaaaacaacgtaaaacctaaaccggtttaggggtcggtttaccggggacccgggtacggggaaccccgtaaaacgtacggtaacccggttacccgtaccgggttaccaacggccccgaaaacggtcccgtcccggtaccccccgtaccggggttccctaacccttaccgtttacccccgg

SEQ ID NO: 354082 - DNA, 618 bp, Homo sapiens
  misc_feature: GZ8MTXP02JV00M.52.76.G10.1.454.CMB.2.raw
  modified_base (275)..(275): a, c, t, g, unknown or other
  misc_feature (275)..(275): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggaggcgtggtccagcctggggaggtccctgagactctcctgtgcaggctctgctatttccctanaataactatgctatcgattcggccgcaggcctcgaggcaaggggctgggagtggggtgcaggtaatactcagctagagtggagcaaacttaaatcttacgctagtattcgtggcgagggggccctattccgaaccctatactaccgagacgaaccaacctacccgaaagtactagtagtaattaattaactacttaaaaccaaaagttcgaaaactacgtacccgtaggaaccgtaacccgtagggaaaccggtaaaccgaccggggtacttacggttaaagtttaacttaacgtggtacggtccgggtacgggtacgggggacttaggggtccgtacccggg

SEQ ID NO: 354083 - DNA, 659 bp, Homo sapiens
  misc_feature: GZ8MTXP02JS21U.52.76.G10.1.454.CMB.2.raw
  modified_base (272)..(272): a, c, t, g, unknown or other
  misc_feature (272)..(272): n is a, c, g, or t
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggagcgtggtccagcctgggaggtccctgagactctcctgtgcaggctctgcatttcccctanaatactntgctatcgagttcggccncgaggcctcgaggacgaagggctgggaggtgggtgactaagtaatacgtcgagtctaggagtgggacgactaaacttaaagtacgttacgataagtatttcgtaggacgggtacggggaccgtacgttaccgaaccgtaactactaccgaagaacgaaacctaaacctaaccgaaagtaaataacgtagtaacttaacgtaacttaaccgtaaaactaaaacgtaacgaaaacgaccgtaccgtaaggaacgtaaccgtacggaaacggtaaccgtaaccggtacgttaacgttaaacgttaacgttaacggtggtacggtaccggtacggggacgggggtaccgtaacggtccggtaccgg

SEQ ID NO: 354084 - DNA, 618 bp, Homo sapiens
  misc_feature: GZ8MTXP02J0FTT.52.76.G10.1.454.CMB.2.raw
  modified_base (207)..(207): a, c, t, g, unknown or other
  misc_feature (207)..(207): n is a, c, g, or t
  modified_base (384)..(384): a, c, t, g, unknown or other
  misc_feature (384)..(384): n is a, c, g, or t
  modified_base (484)..(484): a, c, t, g, unknown or other
  misc_feature (484)..(484): n is a, c, g, or t
tcagcgcagtacgacacgaccggtgctcgatttagtcactcatacagggggctgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccntctcctgcacgtgaaccagcaatgacgttgtacttatactctgtctctagtaccaacaactaccccggacaaacgtaccccaaactcatgacttctttaggaggtcagtgacgtccggcccgtcgtaggggttctcgtacgtcgtcttcccgtccgtacttaccaacgtcgtggacncggaccaccgggtccctcccgtacgacctactcctcgtcggggacctccgaggtctggacggcgagggtctagtatttactacgtcgacagtctactaanaaccaaacaaaacgaacgaaaaccgtggttacgggtaggttcgggacggaccgggaaccaaacgtccggaccgtaccgtacgaccacgacccgaaggtcccgtaccgccccgtacggcctaccgtccgttcccg

SEQ ID NO: 354085 - DNA, 633 bp, Homo sapiens
  misc_feature: GZ8MTXP02FEA16.52.76.G10.1.454.CMB.2.raw
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (296)..(296): a, c, t, g, unknown or other
  misc_feature (296)..(296): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggagcgtggtccagcctgggagtccctgagactctcctgtgcaggctctgcatttcccctanaatactntgctatcgagttcggccnccaggctcgaggcgaagggctgggaggttggggtgactaagttaatactcgagctaggagtgggacgacaaacttaaaattacgttaccgactaagtactttcgtacggacgggaacgggggacccgtaacttaccaaaccctaataactacccgaaagaacgaaacctaaaccctaaacccgaaagtaaacttaatagtaaattaactaacttaacctaaaacaaaagtaacgaaacaacgaccgtagaacgtaaccgtaggaacggaaccgaacggtactacgttacttaacgttacgtggtacggtcggtacggacgggggacgacggtcgccg

SEQ ID NO: 354086 - DNA, 558 bp, Homo sapiens
  misc_feature: GZ8MTXP02GB9TL.52.76.G10.1.454.CMB.2.raw
tcagcgcagtacgacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttgtacttataactctgtctctggtaccaacaataccccggcaaagtccccaaactcatgatctttgaggtcagtgatcggcccgcgtaggggtttctcatcgcttctccggcctccaagtctggcagcacgcctcctgaccatctctcgggctccaggctgagacgaggctgagttatacgtgacagctcataacaacaaaacaacgaaaactacgttgggtcgttacgggacggtacgggaaccaaaacgtcgaacccgtcctacgtccgacgacccgaaggcctaacgcccccgtacggtccaacgttccgtcgtacccctacccc

SEQ ID NO: 354087 - DNA, 562 bp, Homo sapiens
  misc_feature: GZ8MTXP02H7HEP.52.76.G10.1.454.CMB.2.raw
  modified_base (226)..(226): a, c, t, g, unknown or other
  misc_feature (226)..(226): n is a, c, g, or t
  modified_base (245)..(245): a, c, t, g, unknown or other
  misc_feature (245)..(245): n is a, c, g, or t
  modified_base (364)..(364): a, c, t, g, unknown or other
  misc_feature (364)..(364): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
  modified_base (449)..(449): a, c, t, g, unknown or other
  misc_feature (449)..(449): n is a, c, g, or t
  modified_base (458)..(458): a, c, t, g, unknown or other
  misc_feature (458)..(458): n is a, c, g, or t
tcagcgcagtacgacacgaccggtgctcgatttagtcactcatacagggggctggggtctcaggaggcagcgctctcgggacgtctccaccatggcctgggctctgctattcctcacccctcctcactcagggcacagggtcctgggcccagtctgccctgactcagcctgcctccgtgtctgggtctcctggacagtcgatcaccatctcctgcactggaaaccngcaatgacgtttgacttanaactctgtctctgtaaccaacaactaccccggacaaacgtccccaaactcatgatctttgagtcagtgatcggcccgcgtaggggttctctatcgtctccctcggcctcaagtctggcngccacggccctcctgacatctcgtggctcaggctgacgagaggctagtattatactgcagtntacanaacaacaaanataaaacngtttagggngttcgggcgggacggaaccaaaacgtcgtaaccggtccctaacgtaccgacgaccccgaaagtccgtacccggaccccctcggtccaaccgtttaccttccccg

SEQ ID NO: 354088 - DNA, 549 bp, Homo sapiens
  misc_feature: GZ8MTXP02JNIYT.52.76.G10.1.454.CMB.2.raw
tcagcgcagtacgacacgaccggtgctcgatttagtcactcatacagggcacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatcaccatctcctgcactggaaccagcaatgacgttggtacttataactctgtctcctggtaccaacaactaccccggcaaacgtccccaaactcatgatcttgacgtcagtgactcggcccgcgtaggggtttctcacgtccgcttcgtccggctccaagtctggcagccacggccctccctgaccctatctcgtcgggtcctccgaggtctggacggacgaggctaggtattattactgtcacgctacatacacaaacacgtaactaacgttgggtacgttcggacgggtacggaaccaaacgtcgtaacccg

SEQ ID NO: 354089 - DNA, 565 bp, Homo sapiens
  misc_feature: GZ8MTXP02JBTPF.52.76.G10.1.454.CMB.2.raw
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
  modified_base (350)..(350): a, c, t, g, unknown or other
  misc_feature (350)..(350): n is a, c, g, or t
tcagcgcagtacgacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttgtacttataactntgtctctgtaccaacactacccggcaaacgtccccaaactcatgatctttgagtcagtgatcgccgngtagggtttcncatcgctcgtcgcctcagtctggcagcncggcctcctgaccatctcgtgggctccgaggctgaggacgagtctagtattatacgtgacacgctacataacacaaaacagaaactacgttagggtcgttacgggaccggacggaacctaaaacgtcgaacccgtaccgttaacgtaccgacgacccgaacggcccttaaccgcccccgtacggtaccaccgtccttcccggttacccctccccc

SEQ ID NO: 354090 - DNA, 544 bp, Homo sapiens
  misc_feature: GZ8MTXP02GX4L6.52.76.G10.1.454.CMB.2.raw
  modified_base (334)..(334): a, c, t, g, unknown or other
  misc_feature (334)..(334): n is a, c, g, or t
  modified_base (440)..(440): a, c, t, g, unknown or other
  misc_feature (440)..(440): n is a, c, g, or t
  modified_base (535)..(535): a, c, t, g, unknown or other
  misc_feature (535)..(535): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctctgtaccaacaactaccccgcaaacgtccccaaactcatgatctttgaggtcagtgatcggacccgcgtacggggtttcncatcgcttcccgtcccggctacccgaagtctggcagccacggcctcccctgacctatcctcgtcggctacccgagctgacggcgaggctgattatactgctgctanactacaacaaacagaaactacgtgggtacgtcggacggacggaacacgtacgaccgtcacgtacacgacccgaaggcctcgtcccctcggtaccncgttcgtcg

SEQ ID NO: 354091 - DNA, 589 bp, Homo sapiens
  misc_feature: GZ8MTXP02JW6VN.52.76.G10.1.454.CMB.2.raw
tcagcgcagtacgacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaactaccccggcaaacgtccccaaactcatgatctttgagtcagtgatcggccgcgaggggtttctcatcgcttctcggcctccagtctggcagcaccggcctcctcgaccatctcgtcggggtcctccgaggctaggacggacgaggctgtaacttatactgacagctacataacaacaaaacacgaaaactacgtttggggtgttcgggacgggacgggaacctaaaacgtccggaacccgtaccgtacggtacaccgacccgtaacggcctaacccggcccccttcgggtccctaaccgttccgttcccggttccccgtccccc

SEQ ID NO: 354092 - DNA, 738 bp, Homo sapiens
  misc_feature: GZ8MTXP02GWV4G.52.76.G10.1.454.CMB.2.raw
  modified_base (272)..(272): a, c, t, g, unknown or other
  misc_feature (272)..(272): n is a, c, g, or t
  modified_base (279)..(279): a, c, t, g, unknown or other
  misc_feature (279)..(279): n is a, c, g, or t
  modified_base (297)..(297): a, c, t, g, unknown or other
  misc_feature (297)..(297): n is a, c, g, or t
  modified_base (327)..(327): a, c, t, g, unknown or other
  misc_feature (327)..(327): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggagcgtggtccaggcctgggagtccctgagactctcctgtgcaggctctgcatttcccctanaatactntgctatcgtagtcggccncgagctcgaggcgaaggctgggaggtgggngacaagtaatactacgagtcgtaggtagtgggaacgtacctaaacgttaaagttacgttacgacgtaacgttacgtttaccgtacgggtaccggggtaacgggggtaccctaacgttacccgaaaccgtacttaaccgtaccgaaacggtaacgtaaacccgtaaacccgttaaacccgaaaggtaacttaacgttaacgtaaactttaaacgttaaccgttaaaccgttaaaacgtaaaacgttaacgtaaaaccgtacggtacccgtaacgggtaaacccggtaaaccggtacgggaaaccggtaaccggtaacgggttaccgttaacggttaaacttaacgtttaaccggtaacggttaccggtacgggttacggggaacgggggtaccgtacgggttcggtacccgg

SEQ ID NO: 354093 - DNA, 646 bp, Homo sapiens
  misc_feature: GZ8MTXP02H4W07.52.76.G10.1.454.CMB.2.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (363)..(363): a, c, t, g, unknown or other
  misc_feature (363)..(363): n is a, c, g, or t
  modified_base (388)..(388): a, c, t, g, unknown or other
  misc_feature (388)..(388): n is a, c, g, or t
  modified_base (426)..(426): a, c, t, g, unknown or other
  misc_feature (426)..(426): n is a, c, g, or t
tcagcgcagtacgacacgaccggtgctcgatttagtcactcatacagggggctggggtctcaggaggcagcgctctcgggacgtctccaccatggcctgggctctgctattcctcacccctcctcactcagggcacagggtcctgggcccagtctcgccctgactcagcctgcctccgtgtcgtggtctcctggacagtcgatcaccatctcctgcactggaaccngacaatgacgttgtactataactntgtctccgtgtaaccaacaactacccggacaaacgtccccaaatcatgattctttgagtcagtgacgtccggccgtgtagggttcactagtcgtctcccgccgctacgacgtntacggcagccgcgtaccctccgtanacctatcgtccgtggcctccgagggctaggacggacgnggtactgtatttaacgtcgtagacacgtcctaactaactaaaccaaacgaaaacgaaacgtaaaacggttacggttacggggtacgggttaccgggaccggggtaacgggaaaacccttaacggtaccggtaaacccggtaccgttaaccggacccgtaaccggaccggtaacccggtccgtacccgcccccgttggtacccctacgttaccctcccccg

SEQ ID NO: 354094 - DNA, 550 bp, Homo sapiens
  misc_feature: GZ8MTXP02G2G7S.52.76.G10.1.454.CMB.2.raw
  modified_base (220)..(220): a, c, t, g, unknown or other
  misc_feature (220)..(220): n is a, c, g, or t
  modified_base (297)..(297): a, c, t, g, unknown or other
  misc_feature (297)..(297): n is a, c, g, or t
  modified_base (365)..(365): a, c, t, g, unknown or other
  misc_feature (365)..(365): n is a, c, g, or t
  modified_base (374)..(374): a, c, t, g, unknown or other
  misc_feature (374)..(374): n is a, c, g, or t
tcagcgcagtacgacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttggtacttataactctgtctcctggtaccaacaactaccccggacaaacgtccccaaactcatgatntttgaggtcagtgatcggccgcgaggggtttctcatcgtcttcgtccggtcctaccagtctggcagcncggcctccngaccatcgtcgtcgggctccgaggctggacggacgagggctgattattactgacagtctacactaacacaaaacaagaaactacggttaggagttcgggacggtcggaacaaacgtcgaccgtcctacgacacgccgaagcctcgccccgtacggtcactccgtcgttacccaccc

SEQ ID NO: 354095 - DNA, 522 bp, Homo sapiens
  misc_feature: GZ8MTXP02FH8F8.52.76.G10.1.454.CMB.2.raw
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
  modified_base (312)..(313): a, c, t, g, unknown or other
  misc_feature (312)..(313): n is a, c, g, or t
  modified_base (316)..(316): a, c, t, g, unknown or other
  misc_feature (316)..(316): n is a, c, g, or t
  modified_base (322)..(323): a, c, t, g, unknown or other
  misc_feature (322)..(323): n is a, c, g, or t
  modified_base (329)..(329): a, c, t, g, unknown or other
  misc_feature (329)..(329): n is a, c, g, or t
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
tcagcgcagtacgacacgaccggtgctcgatttagtcactcatacagggggctctgggagacgagccagcactggaagtcgccggtgtttccattcggtgatcatcactgaacacagaggactcaccatggagtttgggcagagctgggttctcctcgttgttcttttaagagtgtccagtgtcaggtgcagctgtgagtcgtgggggagcgtggtcccagcctggggacgtccctgacgctctcctgtcgcaaggctntgcattcccctaanaatacntnctntcgngtcggccncgngcncgagcgaggnnggngtgggnntagtancncagctagagngagcaactaactactacgcagtatcgtcgacggacggacgtactacacacacacacgacgacacaccaacatatatatactactactaacaaactaacgaacacgacgtacgacgacgacgacgacgacgtacgtacgtactacgtacgtcgtcgtacggtacggacggacgacgtcgtcg

SEQ ID NO: 354096 - DNA, 541 bp, Homo sapiens
  misc_feature: GZ8MTXP02I6TXD.52.76.G10.1.454.CMB.2.raw
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (295)..(295): a, c, t, g, unknown or other
  misc_feature (295)..(295): n is a, c, g, or t
  modified_base (371)..(371): a, c, t, g, unknown or other
  misc_feature (371)..(371): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggagcgtggtccagcctgggagtccctgagactctcctgtgcaggctctgcatttcccctnaatactatgctancgattgggtccnccaggctccaggcaagggactggagtgggtagcagttaacatcagctagactggagctaactaaagtattaccggntaagtattcgtgacggagggcccgattaccgaccagtacaccgagacgaacaactacccaaagtactatagatataatacaacgtaaatcgaaacaaggcctaggactaccgagaagacgacgactacgtaatatactaagtcgacgtacggaggggtcacggtcgccgg

SEQ ID NO: 354097 - DNA, 591 bp, Homo sapiens
  misc_feature: GZ8MTXP02JH2QZ.52.76.G10.1.454.CMB.2.raw
  modified_base (239)..(239): a, c, t, g, unknown or other
  misc_feature (239)..(239): n is a, c, g, or t
  modified_base (255)..(255): a, c, t, g, unknown or other
  misc_feature (255)..(255): n is a, c, g, or t
  modified_base (495)..(495): a, c, t, g, unknown or other
  misc_feature (495)..(495): n is a, c, g, or t
tcagcgcagtacgacacgaccggtgctcgatttagtcactcatacagggcacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctcgtgtctgggtctccgtgacagtcgatcacntctctgcactgaaccngcaatgacgtgtactatactctgtctctgtaccaacaactaccccgacaaacgtaccccaaactcatgtatcttgacgtcagtgagtcggccgcgtacggggtttctctagtccgtcttcgtcccggtctacctaacgttccgtcggcgacgccgaccggccctcccgtcgaccctactccttccgtcgggtccttccgcgtcgtagggacggaccgaggtctaggtattacgttacgcncgtacgtactactaactaacaaacaaacgtaaacgtaaacgtacggtaacggtacggtacggtaccgggtaccggtaaccgtaaccgtacgtaccg

SEQ ID NO: 354098 - DNA, 541 bp, Homo sapiens
  misc_feature: GZ8MTXP02JCDBT.52.76.G10.1.454.CMB.2.raw
  modified_base (358)..(358): a, c, t, g, unknown or other
  misc_feature (358)..(358): n is a, c, g, or t
tcagcgcagtacgacacgaccggtgctcgatttagtcactcatacagggcacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctcgtgtctgggtctccgtggacagtcgatcacatctcctgcactggaaccagcaatgacgttggtacttataactctgtctcctgtaccaacaactaccccggcaaaacgtccccaaactcatgatctttgacgtcagtgatcggccgcgnggggtttctcgatcgcttctccgctccaagtctgcagcacggccctccctgtaccactctcgtcgggtcctccgaggtcctaggacgacggaggctagatttatacgtgcacgctacactaacacaaacaacgaactacgttcgggtgttccggacggtacggaaccaaccgtcgtaacccgg

SEQ ID NO: 354099 - DNA, 591 bp, Homo sapiens
  misc_feature: GZ8MTXP02IITSZ.52.76.G10.1.454.CMB.2.raw
  modified_base (239)..(239): a, c, t, g, unknown or other
  misc_feature (239)..(239): n is a, c, g, or t
  modified_base (261)..(261): a, c, t, g, unknown or other
  misc_feature (261)..(261): n is a, c, g, or t
  modified_base (443)..(443): a, c, t, g, unknown or other
  misc_feature (443)..(443): n is a, c, g, or t
tcagcgcagtacgacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcaatgacgttggtacttanaactctgtctcctggtaccaanaactaccccggcaaacgtccccaaactacatgatctttgaggtcagtgaatcggacccgcgtacggggtttctcgactcgtcttctccggtcctaccaagtctggcaacgccaccgggtcctccctaggacccatcctcgtcgggctccgaggctggaggacgaggctgtaattattaccgngcacgactacaactaacaacaaacaacgtaaactacggttcggtacggttacgggacgggtaccgggaaccaaacgtcggaccgtacctacgacgaccgaccgacgccgtccgtccccgtacgtcctacgtccttcccgtaccctccc

SEQ ID NO: 354100 - DNA, 501 bp, Homo sapiens
  misc_feature: GZ8MTXP02FOG15.52.76.G10.1.454.CMB.2.raw
  modified_base (273)..(273): a, c, t, g, unknown or other
  misc_feature (273)..(273): n is a, c, g, or t
  modified_base (360)..(360): a, c, t, g, unknown or other
  misc_feature (360)..(360): n is a, c, g, or t
  modified_base (440)..(440): a, c, t, g, unknown or other
  misc_feature (440)..(440): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggaggcgtggtccagcctgggaggtccctgagactctcctgtgcaggctctgcatttccccttnaataactatgctatcgattgggtccgccaggctccaggcaagggactggagtgggtgcagtatatcagctgatggaggcactaaatnttacgcagattctgcgaggggccgattcaccatatccagagacaactacccaagatatgatatatctaacaaatgaacanccgtagacgacctgaggacacggctgtactattactgtgcgtcgagggggcaggtcgtccg

SEQ ID NO: 354101 - DNA, 609 bp, Homo sapiens
  misc_feature: GZ8MTXP02F6IUM.52.76.G10.1.454.CMB.2.raw
tcagcgcagtacgacacgaccggtgctcgatttagtcactcatacagggcacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctctgcactggaaccagcaatgacgttggtacttataactctgtctctgtaccaacaactaccccggacaaaacgtccccaaactctaatgtatctttgacggtcagtgactccggacccgtcgtagggggtttcctcgtactccgtccttcgtccggtctccctaagtctcggcacgcgaccggccctcccgtcgaccagtctcgttcgggcctccgagcctacggaggaccgagcgtaggtatttacgtactcggactacggtcgttacaactaaacgaaaccaaaacgaacgtaaaccgtaaccgtttgggtaacggttccgggaccgggtaccgggaaccgtaaaccgtacggtaaacccccgg

SEQ ID NO: 354102 - DNA, 735 bp, Homo sapiens
  misc_feature: GZ8MTXP02HI2CR.52.76.G10.1.454.CMB.2.raw
  modified_base (206)..(206): a, c, t, g, unknown or other
  misc_feature (206)..(206): n is a, c, g, or t
  modified_base (224)..(224): a, c, t, g, unknown or other
  misc_feature (224)..(224): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccntctcctgcactggaaccngcaatgacgttgtacttatactctgtctctgtaccaacactacccgcaacgtccccaaactcatgatctttgaggtcagtgacgtccggcccgcgtagggtttcctcgtactcgtccttccgtcccggtctaccgaagttcctgggcacgccgaacccggtccctcccccgtaggtacccacttcccgtcgttcggggcccttacccgacgggtcgtacgggaacgggcccggaagggtccgttaggtactttaacgttaaccgttcgggtacctaacggttcccgtacctaaacgtaaccaaaaccctaaaaacgaaacgtaaaaaaccgttcggtttaaccgggggtcggtttaccgggggacccggggaaaccggggtaaaaccccgtaaaacggtacccggtaaacccgttacccggtaacccgttaccgaaccggtaacccccgtaaacggccccggtaacccgtccccccggtacggtcccttaacccggttccgtttccccccg

SEQ ID NO: 354103 - DNA, 655 bp, Homo sapiens
  misc_feature: GZ8MTXP02HJO5K.52.76.G10.1.454.CMB.2.raw
  modified_base (276)..(276): a, c, t, g, unknown or other
  misc_feature (276)..(276): n is a, c, g, or t
  modified_base (304)..(304): a, c, t, g, unknown or other
  misc_feature (304)..(304): n is a, c, g, or t
  modified_base (338)..(338): a, c, t, g, unknown or other
  misc_feature (338)..(338): n is a, c, g, or t
  modified_base (584)..(584): a, c, t, g, unknown or other
  misc_feature (584)..(584): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggaggcgtggtccagccgtgggacgtccctgagactctcctgtgcaggctctgctatttcccctanaataactatgctatcgagttcgggtccncgaggctccgaggacaagggactgggagtggggngctagtaatacgtcagtctaggactagggagacgtaaacttaaaatacgttaccgacgtaggtaactttcggagggacgggtaccgggggaccctagttacccaaccctaattaccgcccgaaagtacggaaacccaacccgttaacccgaaaagtacttaagtagtaacttaacttaactaacctaaactaaaagtcgaaaacgtcgacccgttaaggaaccgtaccgtagggaccggtaaaccncgggtacttagtacgttacgttaccgtggtacggtccgttacggggacggggtcaacgggtttcgacccgg

SEQ ID NO: 354104 - DNA, 582 bp, Homo sapiens
  misc_feature: GZ8MTXP02G3LL9.52.76.G10.1.454.CMB.2.raw
  modified_base (225)..(225): a, c, t, g, unknown or other
  misc_feature (225)..(225): n is a, c, g, or t
  modified_base (391)..(391): a, c, t, g, unknown or other
  misc_feature (391)..(391): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatcctcctgcactggaaccngcaatgacgttgtacttatactctgtctctgtaccaacaactaccccggacaaacgtacccccaaaactcatgtattcgtttggagtcagtgacgtcggcccgtcgtaggggtttctctagtcgtcttcccgtccgtctaccaagtctgcacgcacggccctcccncgactactcctcgtcggctccgaggctggaggtacgaggtctagtattacttactgcagctacataacaaacaaacagaaactcgttggtacgtcggacgggtacggaacctaaagtccgaccgtacccgttacgaccgacgtacccgaaggtccctccgtacccccgtggtaccccaccgttacctcccg

SEQ ID NO: 354105 - DNA, 592 bp, Homo sapiens
  misc_feature: GZ8MTXP02IFH0Z.52.76.G10.1.454.CMB.2.raw
  modified_base (396)..(396): a, c, t, g, unknown or other
  misc_feature (396)..(396): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggagcgtggtccagcctgggaggtccctgagactctcctgtgcaggctctgctatttccctacaataactatgctatcgattcgggccgccaggcctaccgaggccgaaggggtacgtgggtaggtggggtaggcaaggtaatacgtcagctgagtggagctaactaaatacttacgcagtattcgngcggaggggtccattccgaacatactacagacaccaactacccaaagaactatagacttataactactaaacaaagttacgaaacgtcgaccgttaagaaccgtaccgtaggacggtaccgacgggtacttaggtaaactttacgtttaacgtggtacggacggttacgggacgggggacctagggtcgtacccgg

SEQ ID NO: 354106 - DNA, 609 bp, Homo sapiens
  misc_feature: GZ8MTXP02FJU7J.52.76.G10.1.454.CMB.2.raw
  modified_base (262)..(262): a, c, t, g, unknown or other
  misc_feature (262)..(262): n is a, c, g, or t
  modified_base (276)..(276): a, c, t, g, unknown or other
  misc_feature (276)..(276): n is a, c, g, or t
  modified_base (303)..(303): a, c, t, g, unknown or other
  misc_feature (303)..(303): n is a, c, g, or t
  modified_base (450)..(450): a, c, t, g, unknown or other
  misc_feature (450)..(450): n is a, c, g, or t
  modified_base (485)..(485): a, c, t, g, unknown or other
  misc_feature (485)..(485): n is a, c, g, or t
  modified_base (503)..(503): a, c, t, g, unknown or other
  misc_feature (503)..(503): n is a, c, g, or t
  modified_base (515)..(515): a, c, t, g, unknown or other
  misc_feature (515)..(515): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggaggcgtggtccagccgtggggaggtccctgagactctcctgtgcaggctngctatttcccctanaataactatgctatcgattcgggtccnccaggcctaccgaggcaaggggctggggaggttcggggtagactagtaaatcgtcagctaggagtgggacggtcaaacttaaattacgttaccgactaaggtactttcgacggcgggaacgggggtccctaattaccaacccttaanactaccgaagacgaaccaacctacccaaagtatanagtataatactaacaaanaaatacgaaacngtaccgtagaacgtacgaggaaacggaccacggtactaagttaactagttaacggtgtacggtacggtacgggacggggactacggtcgtacgg

SEQ ID NO: 354107 - DNA, 583 bp, Homo sapiens
  misc_feature: GZ8MTXP02INPP1.52.76.G10.1.454.CMB.2.raw
  modified_base (189)..(189): a, c, t, g, unknown or other
  misc_feature (189)..(189): n is a, c, g, or t
  modified_base (238)..(238): a, c, t, g, unknown or other
  misc_feature (238)..(238): n is a, c, g, or t
  modified_base (367)..(367): a, c, t, g, unknown or other
  misc_feature (367)..(367): n is a, c, g, or t
  modified_base (437)..(437): a, c, t, g, unknown or other
  misc_feature (437)..(437): n is a, c, g, or t
tcagcgcagtacgacacgaccggtgctcgatttagtcactcatacagggggggtctcaggaggcagcgctctcgggacgtctccaccatggcctgggctctgctattcctcaccctcctcactcaggcacagggtcctgggcccagtctgccctgactcagcctgcctcgtgtctgggtctcctggacngtcgatcaccatctcctgcactggaaccagcaatgacgttggtacttanaactctgtctcctggtacaacaatacccggcaaacgccccaaactcatgatctttgagtcagtgatcggcccgcgtaggggtttctctatcgtcgttcctccggtcctacccgaacgtctggcacgccnccgggtcctcccctcgacctactctcgtcgggcctcgacggcgtgaggaccgaggcctgtattattacgngtcgacgtctacatacaacaaaacagaaacgtcgttagggtcgttcggacggacggacgaaacgtcgaaccgtccgtaaacgtccgacgtaccccgaagccgtcgcccccgttacggtccctactccgtccgttaccctacccccg

SEQ ID NO: 354108 - DNA, 586 bp, Homo sapiens
  misc_feature: GZ8MTXP02F5B6P.52.76.G10.1.454.CMB.2.raw
  modified_base (331)..(331): a, c, t, g, unknown or other
  misc_feature (331)..(331): n is a, c, g, or t
  modified_base (431)..(431): a, c, t, g, unknown or other
  misc_feature (431)..(431): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctctggtaccaacaataccccggcaaacgtccccaaactcatgatctttgaggtcagtgatcggcccgcaggggtttcncatcgctctccgctcaagtctggcagccacggcctccctgaccatcctctgggcctcccgaggctggacggaccgaagggctagtaacttatttaaccgngacacgtctacaactaaccaaacaaaacgaaacgtaaacgtacggttacgggtacggtcgggaccgggaaccggaactaaacgtcgaacccgtaccgtaccgtaccgacgacccgaacgccgtacccgtaccccgtcgtacctaccttcgtcccg

SEQ ID NO: 354109 - DNA, 621 bp, Homo sapiens
  misc_feature: GZ8MTXP02G2VXR.52.76.G10.1.454.CMB.2.raw
  modified_base (263)..(263): a, c, t, g, unknown or other
  misc_feature (263)..(263): n is a, c, g, or t
  modified_base (277)..(277): a, c, t, g, unknown or other
  misc_feature (277)..(277): n is a, c, g, or t
  modified_base (309)..(309): a, c, t, g, unknown or other
  misc_feature (309)..(309): n is a, c, g, or t
  modified_base (382)..(382): a, c, t, g, unknown or other
  misc_feature (382)..(382): n is a, c, g, or t
  modified_base (546)..(546): a, c, t, g, unknown or other
  misc_feature (546)..(546): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagcgtggtggagtcgtgggggagcgtggtccagccgtgggacgtccctgagacctctccgtgtgcaggctngctactttccctanaataactatcgactagtcgagtttcgggcccncgacggtctccgaggacgaaggggctgggaggtgggtaggactaaggtaatcgacgagtactaggagtggganacctaaattaaaattacgtacgacgtaagtcttcgtggacggaggggacctagtaccgaacctatactacgaagaacgaaccaaccgtaacccaaagtactaagtagtaattataaactactaaactaaacgtaacgaaacgactaccgtagacgtaaacccgngggaaacgaacgacggtacttacgtaaattcgttacggtgtacggacgggtacggagggggtcacggttcgccgg

SEQ ID NO: 354110 - DNA, 619 bp, Homo sapiens
  misc_feature: GZ8MTXP02F6Y2B.52.76.G10.1.454.CMB.2.raw
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
  modified_base (330)..(330): a, c, t, g, unknown or other
  misc_feature (330)..(330): n is a, c, g, or t
  modified_base (359)..(359): a, c, t, g, unknown or other
  misc_feature (359)..(359): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggagcgtggtccagccgtgggagtccctgagctctctgtgcaggctctgctattccctnaatactatgctatcgattgggccncaggctccgaggcgaaggctggagtgggtgcagtaanatcgagtctagagtggagctaactaaatntacgcagtattactgacggaggggccgtatcacctatactaccgagacgaacaacctacccgaaagaacttagtacgtaattaagttactaacctaactaaaagttcgaaaaccgtacgtacccgtaggaaaccgtacccgtagggaaccggtaccgaaacgggtacccgttaacgttaacgtttaaacctttaaaggtcggttacggaaccggtttaccgggaacggggggtccctaaggggtaccggttaccccgggg

SEQ ID NO: 354111 - DNA, 537 bp, Homo sapiens
  misc_feature: GZ8MTXP02JOLQI.52.76.G10.1.454.CMB.2.raw
  modified_base (270)..(270): a, c, t, g, unknown or other
  misc_feature (270)..(270): n is a, c, g, or t
  modified_base (365)..(365): a, c, t, g, unknown or other
  misc_feature (365)..(365): n is a, c, g, or t
  modified_base (373)..(373): a, c, t, g, unknown or other
  misc_feature (373)..(373): n is a, c, g, or t
  modified_base (501)..(501): a, c, t, g, unknown or other
  misc_feature (501)..(501): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtctgggggaggcgtggtccagcctgggagtccctgagactctcctgtgcaggctctgcatttccctnaataactatgctatcgattgggtccgccaggctccaggcaagggctggagtgggtgcagtaatatcagctgatgggagcaaacgtaaatatacgnagtattcngcgaggggcattcaccatactccaagacacaactacccgaagatactagattatatacctaaacaaatacgaaacagacctagacgtaacctggaacggaaccacgggacttaggtaatagtttacgnggttacgcggttacggagggggctaaggtcgcccgg

SEQ ID NO: 354112 - DNA, 678 bp, Homo sapiens
  misc_feature: GZ8MTXP02IXRE3.52.76.G10.1.454.CMB.2.raw
  modified_base (236)..(236): a, c, t, g, unknown or other
  misc_feature (236)..(236): n is a, c, g, or t
tcagcgcagtacgacacgaccggtgctcgatttagtcactcatacagggcacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctcgtgtctggtctctggacagtcatcacntctctgcactgacagcaatgacgttgtacttataactctgtctcctggtaccaacaactaccccggcaaacgtccccaaactcatgatctttgacgtcagtgactcggcccgtcgtagggggtttcctactactccgtccttccgtcccgggtctacccgaaagttccttcgggaccaacggtcccgaccgggtcccccttaccccgttcggtaaccccacttccgttaccgttcggggtcccttaccccgacgggtcccgttagggaaccgggtaccggaacgggtccgttacgggtaatttaactttaaccgtcggctaacggtcctacctaacttaaactaaaccaaaacgaaacgtaaaaccgttaccggtttaaggggtaccggtttaccgggaccgggtaccggggaaaccctaaaccggtacggttaacccccgg

SEQ ID NO: 354113 - DNA, 634 bp, Homo sapiens
  misc_feature: GZ8MTXP02GVXYA.52.76.G10.1.454.CMB.2.raw
  modified_base (307)..(307): a, c, t, g, unknown or other
  misc_feature (307)..(307): n is a, c, g, or t
  modified_base (332)..(332): a, c, t, g, unknown or other
  misc_feature (332)..(332): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctggtctcctggacagtcgatcaccatctcctgcactggaaccagcaatgacgttgtacttatactctgtctcctggtaccaacaactaccccggacaaacgtaccccaaactcatgatctttgagtnagtgatcggcccgcgtagggtttcncatcgtcttcccgtccgctacagtctggcacgcacggccctcccgtcgacctatcctcgtcgggcctccgaggtcctagggaacggaccgaggtactaggtaactttaagtttaaccgcgacgtaacgccttacgaacttaaccaaaaccaaaacgaacgtaaaaccgtaacggtttacggggttcggttaccggggaccgggaccggggaaaccctaaaacgtccgtaacccggttacctaccgtacgaccgaccgaaacggtcctcccgtaccccgtcggtacctaccgtccttaccccg

SEQ ID NO: 354114 - DNA, 659 bp, Homo sapiens
  misc_feature: GZ8MTXP02HP47H.52.76.G10.1.454.CMB.2.raw
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (318)..(318): a, c, t, g, unknown or other
  misc_feature (318)..(318): n is a, c, g, or t
  modified_base (329)..(329): a, c, t, g, unknown or other
  misc_feature (329)..(329): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttgacttatactntgtctctaggtaccaacaactaccccggacaaacgtaccccaaatcatgatctttgagtcagtgagtccggccgngtagggtttcncatcgtcttcgcggtcctaccaagtctgcacgcgccgcctccgtgacctatcgtcgtcggcctacgaggctaggacggacgacggtctagttaacttacgttacgagtccaggtacctttacaactaaacaaaacccgtaaaaacgtaaacgtaaacggttacggttacgggggtaccggttaccggggaccggggtaaaccggtaaaacccgtaaacggtccggtaaaccccgtaccgtaccggtaccgtaaccgtacccgacggtcccgtaaccccgtaccccggtaccgtacctaccgttacccgttacccgttaccccgtaccccg

SEQ ID NO: 354115 - DNA, 544 bp, Homo sapiens
  misc_feature: GZ8MTXP02GKISE.52.76.G10.1.454.CMB.2.raw
  modified_base (329)..(329): a, c, t, g, unknown or other
  misc_feature (329)..(329): n is a, c, g, or t
  modified_base (357)..(357): a, c, t, g, unknown or other
  misc_feature (357)..(357): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcacatctcctgcactggaaccagcaatgacgttggtacttataactctgtctctggtaccaacaataccccggcaaacgtccccaaactcatgatctttgagtcagtgatcggcccgcaggggtttcncatcgcttccgtccgctcaagtctggcngcacggcctccctgacatctcgtgggcctcgagctgaggacgaggctagattattactgcagctgaatacaacaaacaagaaactagttgggtcgtcgggcggacgggaaccaaacgtcgtacccgtacctacgtacacgacccgaaggccctaccgtcccccgtcggtacctaccgtctttacccg

SEQ ID NO: 354116 - DNA, 635 bp, Homo sapiens
  misc_feature: GZ8MTXP02IUXUJ.52.76.G10.1.454.CMB.2.raw
  modified_base (202)..(202): a, c, t, g, unknown or other
  misc_feature (202)..(202): n is a, c, g, or t
  modified_base (272)..(272): a, c, t, g, unknown or other
  misc_feature (272)..(272): n is a, c, g, or t
  modified_base (305)..(305): a, c, t, g, unknown or other
  misc_feature (305)..(305): n is a, c, g, or t
  modified_base (316)..(316): a, c, t, g, unknown or other
  misc_feature (316)..(316): n is a, c, g, or t
  modified_base (328)..(328): a, c, t, g, unknown or other
  misc_feature (328)..(328): n is a, c, g, or t
  modified_base (365)..(365): a, c, t, g, unknown or other
  misc_feature (365)..(365): n is a, c, g, or t
tcagcgcagtacgacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccntctctgcactgaaccagcaatgacgttggtacttataactctgtctcgtgtaaccaacaactaccccganaacgtacccaaactcatgatctttgagtcagtnacgtcggccgngtacgggtttcnctactcgtcttcgtccgcctccgagtctcggcacgcnccgggtcctcctacgacctactcgtcgtggtccgtcgacgtcgtaggacggacgaggtcgttagtaactttatacgtcgacgacgtcctacgtaacttaaccaaacaaaaccgaacgtaaaccgtaacggtttacggggttcggttacgggacggggtaaccgggaaccgtaaaaccgttacgaacccgttccgtaacgtacgaccgacccggaacgtccgtccgtcccccgtcggtacccaccgttaccgttccgttaccccttacccg

SEQ ID NO: 354117 - DNA, 752 bp, Homo sapiens
  misc_feature: GZ8MTXP02G9ZMP.52.76.G10.1.454.CMB.2.raw
  modified_base (191)..(191): a, c, t, g, unknown or other
  misc_feature (191)..(191): n is a, c, g, or t
  modified_base (277)..(277): a, c, t, g, unknown or other
  misc_feature (277)..(277): n is a, c, g, or t
  modified_base (459)..(459): a, c, t, g, unknown or other
  misc_feature (459)..(459): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtncagctggtggagtcgtgggggagcgtggtccaggccgtgggacgtcctgacgactctcctgtgcaggctctgctactttcccctanaaactactatcgactagtcgtagttcgggcccgtaccgaaggtccctaccgaaggggtaccgaaaaggggtaccttaggggaagggtttcggggtaggaccgtaaaggttaaataccgttaccgaagtcgttaggaacgttggggaaacgtaccctaaaacttaaaagttacgttaacccgngtaaaggtaactttcgtacgggacggtaacgggggtacctacgttaccaaccctaatacgtaccgaaacggtaacgaaccgaaaccgtaaccccaaaggtaaacttaacgttacgtaaatttaagtaaacttaaaccgttaaaaacgtaaaacgtaacgaaacgtaacgtaccgtaacgaacgtaaccgtacggaaacggtaaccgtaccggtacgttaacgttaacgttaacgttacgtaacggtacggtaccgggtacggggaacggggtacgtacggtaccggtacccgg

SEQ ID NO: 354118 - DNA, 658 bp, Homo sapiens
  misc_feature: GZ8MTXP02GCGTF.52.76.G10.1.454.CMB.2.raw
  modified_base (286)..(286): a, c, t, g, unknown or other
  misc_feature (286)..(286): n is a, c, g, or t
  modified_base (528)..(528): a, c, t, g, unknown or other
  misc_feature (528)..(528): n is a, c, g, or t
  modified_base (551)..(551): a, c, t, g, unknown or other
  misc_feature (551)..(551): n is a, c, g, or t
  modified_base (563)..(563): a, c, t, g, unknown or other
  misc_feature (563)..(563): n is a, c, g, or t
  modified_base (618)..(618): a, c, t, g, unknown or other
  misc_feature (618)..(618): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcgaggtgcagcgtgggtggagtcggtgggggagtcggtggtccagccgtggggacgtccctgagacctctccgtgtgcgaggctctgctactttcccctanaataactatgactatcgtagttcgggcccgcgtacggcctacccgaggacgaaaggggaccgtgggtagggtgggtacggagtaagtaactactagacgtcgtagtaggtaggaacgtactaaaacgttaaattacgttaccgagtaagttcgttacggacggggacgggaacggggtcctaacttaaccaaccggtaaatccaacgaagtacgaaaaccctaaccgtacaaatgtaaactntaattaacaacgtaacctaaaanaaacgtacaacnccgtacgagaacgtaacgaggaacgtaccggtatattaacttacgtagttaccgnggtaccggacgggtaacgggcgggtactcggtaccgtcgg

SEQ ID NO: 354119 - DNA, 679 bp, Homo sapiens
  misc_feature: GZ8MTXP02HWQJP.52.76.G10.1.454.CMB.2.raw
  modified_base (220)..(220): a, c, t, g, unknown or other
  misc_feature (220)..(220): n is a, c, g, or t
  modified_base (328)..(328): a, c, t, g, unknown or other
  misc_feature (328)..(328): n is a, c, g, or t
tcagcgcagtacgacacgaccggtgctcgatttagtcactcatacagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttgtacttatactctgtctctggtaccaacaactaccccggacaaacgtacccccaaactcatagtattcgtttagaggtcagtgactccggaccccgngtaggggtttcctacagtccgtcttcctccggcctccaagtctaggcacgcaccggccctccgtcgacctatcgtcgttcgggctccgaggtccgtaggagggacgacggtctaggtaatttactacgtgcgtaacgctacctaataacccaaactaaaaccgaagtaaaacctacggtttaggggtcggttacccggggacggggaacccgggaaaacccgtaaacgttaccggtaaacccgttcccgttaaacgggtaccaccggaccccgtaacggcgttaacccccgcccccggttacggttacccgaaccctttcccgtttacccggtttacccccgttccccccg

SEQ ID NO: 354120 - DNA, 639 bp, Homo sapiens
  misc_feature: GZ8MTXP02GWJLR.52.76.G10.1.454.CMB.2.raw
  modified_base (503)..(503): a, c, t, g, unknown or other
  misc_feature (503)..(503): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggaggcgtggtccagccgtgggacggtccctgagactctcctgtgcgaggctctgctactttccctacaaataactatgtctactcgtagttcggtcccgcgacggcctaccgaggtacgaaaggggcgtggggtaggtggggtggactaaggtaactatcgagcgttaggagtggaaggctaaacgtaaatagttaacgcagtaacgttcgaggcggtaacggggcctaacgttcaaacccgtatacgtaccgaagaaaccaccaaaccgtaccgaaagatatagacttaanacttaacaaaacaaagtacgaaaccacgtacctaggaaccgtactacgggacggtaacctacgggtacttagtaaactttacgttacgtaacggttcggaaccggttggaacgggggcctaaacgggtctcccggg

SEQ ID NO: 354121 - DNA, 701 bp, Homo sapiens
  misc_feature: GZ8MTXP02IKS5M.52.76.G10.1.454.CMB.2.raw
  modified_base (224)..(224): a, c, t, g, unknown or other
  misc_feature (224)..(224): n is a, c, g, or t
  modified_base (321)..(321): a, c, t, g, unknown or other
  misc_feature (321)..(321): n is a, c, g, or t
  modified_base (456)..(456): a, c, t, g, unknown or other
  misc_feature (456)..(456): n is a, c, g, or t
tcagcgcagtacgacacgaccggtgctcgatttagtcactcatacagggggctggggtctcaggaggcagcgctctcgggacgtctccaccatggcctgggctctgctattcctcacccctcctcactcagggcacagggtcctgggcccagtctgccctgactcagcctgcctccgtgtctggtctcctggacagtcgatcaccatctcctgcactggaaccngcaatgacgttgtacttatactctgtctcctggtaccaaacactaccccgacaaacgtccccaaatcatgattctttgagtcagtgatccggcccgngtagggtttcacgtatcgtcttccgcccggtctcgaagtcgtggcagccgaccggcccttccctagaccacttcgtacgtcggcctccgaggcgttaggacggacgacggtacttaggaatttacgttaaccgtnaccgtagtaccctactaacgttaaaacccaaacaaaaaccgtaacggtaaaaaccgttcggtttacggggttacgggtttaccggggaacccggggtaccgggaaaacccgtaaaacggttcccggtaaaccccgttacccgtttaaaccgacccgaaccggtaacccccggaaaacgggttccccgtacccggtacccccccggttacggttacccgttaacccgttcccgtttaaccccccgg

SEQ ID NO: 354122 - DNA, 640 bp, Homo sapiens
  misc_feature: GZ8MTXP02GXHYL.52.76.G10.1.454.CMB.2.raw
  modified_base (224)..(224): a, c, t, g, unknown or other
  misc_feature (224)..(224): n is a, c, g, or t
  modified_base (332)..(332): a, c, t, g, unknown or other
  misc_feature (332)..(332): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccngcaatgacgttgtacttatactctgtctctgtaccaacaactaccccggacaaacgtccccaaactcatgactcttgagtcagtgatcggcccgtcgtaggggtttcncgtatcgtcttccgtccggctaccgaagtctacgggcacgcctaccgggcccttcccgtcgaacctacgttcctcgtcgggtccttccgaggtccgtggaacggacggaacggcttggtactttagttacgttcggcacgtactactaataaccaaacaaaacgacggaaactaacggtttcggggtacgttaccggggcgggtaccgggaacctaaaacgtccggtaaccggtaccgtaacgtaccgaaccgaccgaaacgggtcccttaccgccccgttaccggtcctaccgttcgtttcccccgg

SEQ ID NO: 354123 - DNA, 599 bp, Homo sapiens
  misc_feature: GZ8MTXP02JT169.52.76.G10.1.454.CMB.2.raw
  modified_base (225)..(225): a, c, t, g, unknown or other
  misc_feature (225)..(225): n is a, c, g, or t
  modified_base (337)..(337): a, c, t, g, unknown or other
  misc_feature (337)..(337): n is a, c, g, or t
  modified_base (398)..(398): a, c, t, g, unknown or other
  misc_feature (398)..(398): n is a, c, g, or t
  modified_base (571)..(571): a, c, t, g, unknown or other
  misc_feature (571)..(571): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgccactggaaccngcaatgacgttgtacttataactctgtctcctggtaaccaacaactaccccggcaaacgtccccaaactcactgatctttgagtcagtgatccggcccgcgtaggggtttcnctactcgtcttccgtaccggtctccaagtctcggcacgccgaccggtccctcctcgaaccncttctcgtcgggtcctccgagggtctaggaggaccgaggtaccgtagttaacttacgttactggaccgagtctacaactaacaaaccaaaacagtaaactacggttgggtacgttcgggacggtacggaaacctaaacgtcgaaaccgtccgtacgaccgacgccgaagtccnccgtcccgtcgtcaccgtacgttccccg

SEQ ID NO: 354124 - DNA, 723 bp, Homo sapiens
  misc_feature: GZ8MTXP02FYH0Z.52.76.G10.1.454.CMB.2.raw
  modified_base (224)..(224): a, c, t, g, unknown or other
  misc_feature (224)..(224): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcaggcacagggtcctgggcccagtctgccctgactcagcctgcctccgtgtcgtgggtctcctggacagtcgatcaccatctcctgcactggaaccngcaatgacgttgtacttatactctgtctctgtaccaacaactacccggcaaacgtaccccaaactccatgtattctttgagtcagtgaacgtccggcccgcgtacggggtttctcgtatccggtcttcccgtcccggtcctaccgtaacgttcgtacggcaggacccgaccgggtcccttccccgtacgaaccctactttcccttccgtacggggtcccttacccgaacgggtccgttaggaaacgggaccggaaggtcccgttagtaaactttacgttaacttcggactaacgtcttaacaaactaaaccgaaaaccaaaacgaaacgtaaaaccgtacgtttacgggggttacggtttaccggggaccggggtaaccggggaaaccctaaaaacggttccgtaacccggttacccgttaaccgtaccgaaccggacccgaaacgggtcccttcccggaccccccgttacggtaccctaccgttcccgtttcccccgg

SEQ ID NO: 354125 - DNA, 754 bp, Homo sapiens
  misc_feature: GZ8MTXP02IY84S.52.76.G10.1.454.CMB.2.raw
  modified_base (205)..(205): a, c, t, g, unknown or other
  misc_feature (205)..(205): n is a, c, g, or t
  modified_base (223)..(223): a, c, t, g, unknown or other
  misc_feature (223)..(223): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggccagtctgccctgactcagcctgcctccgtgtctgggtctcctggacagtcgatcaccntctcctgcactggaaccngcaatgacgttggacttatactctgtctcctggtacaaacataccccggacaaacgtccccaaaatcatgaatcgttttagacggttcagtagtacgtccggaccccggtcgtaacgggggttttcctacgtacttccggtcctttccccgtaccccggggtaccttccgaaaacggttccgttaacgggccgacggtaccgacccgggggtcccccttccccgttacggaaccccctaagtcccgttaccgtcgggggttaccccctaccggtacgggtaccgtacgggaacggaccgggtacggtacgttacgtaactttaacgttacgtacgtaccgtacgtacctaactaactaaaaccaaaccgtaaaactaaacggtaaacgttacgggttacgggtacgggtaccggggtaccgggtaaccggtaaccgtaaaccgtacggtaacccgtaccgtaaccgtaccgaaccgaacccgtaacggtcccgtacccgtaccccgtacggtacctaccgttccgtacccg

SEQ ID NO: 354126 - DNA, 681 bp, Homo sapiens
  misc_feature: GZ8MTXP02FMYIE.52.76.G10.1.454.CMB.2.raw
  modified_base (249)..(249): a, c, t, g, unknown or other
  misc_feature (249)..(249): n is a, c, g, or t
  modified_base (322)..(322): a, c, t, g, unknown or other
  misc_feature (322)..(322): n is a, c, g, or t
  modified_base (371)..(371): a, c, t, g, unknown or other
  misc_feature (371)..(371): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctggtctccgtggacagtcgatcaccatctcctgcactggaaccagcaatgacgttgtacttatactctntctctgtaccaacactaccccggacaaacgtaccccaaactcatgatcgtttgagtcagtgactccggcccgngtacggggtttctcgatccgtccttcccgtccgctaccgaagtctggcngccgacggtccctcccgtacgacctatcgtacgtcgggaccttccgaacggtcctaggacggacggaacggtctgtaatttacttaacgtcgaccagtcctacctaaataacccaaaccgtaaaacgaaccgtaaaacgtacgggtttaggggttacgggttaccggggacccgggtaaccgggaaaacccaaacggttaccgggaaaccccgttacccgttaaaccggtaccaaccggaaccccgtaaacgggtcccgtaacccggttcccccgttaaccggtccctaacccgttccgtttaccccccg

SEQ ID NO: 354127 - DNA, 755 bp, Homo sapiens
  misc_feature: GZ8MTXP02GR3IE.52.76.G10.1.454.CMB.2.raw
  modified_base (206)..(206): a, c, t, g, unknown or other
  misc_feature (206)..(206): n is a, c, g, or t
  modified_base (222)..(222): a, c, t, g, unknown or other
  misc_feature (222)..(222): n is a, c, g, or t
  modified_base (500)..(500): a, c, t, g, unknown or other
  misc_feature (500)..(500): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtcgtggtctccgtggacagtcgatcacntctctgcactgaaccngcaatgacgttgtacttatactctgtctcgtacgtaccaaacaactaccccggacaaaccgtaccccaaactcatgtattcgtttagagtcagtgacgtccggcccgcgtaggggtttctacgtacgtccgtcgttccccgtcccggtcctaccgtaacggttcgtacggacctacgggacccgtacccggggtcccccttacccgtacgaacccgtactttcccgtcgtaccggggtacccttaccggacggtacgtacgggaacgggtaacccggnggtaccttaggtaactttaacgtttaccggcgtaccgtacgtacctaaactaaacgtaaaaccaaaaccgtaaaacgtaaacggttaaacggttacggggttacggggttaccgggtaccggggaaccgggtaaacccgggtaaaacccgtaaacggttacccggtaacccgttaccgtaccgtacccgaaccggtaacccggtaaccgtcccgtaccccgtacccggtacgtaccctaccgtttacccgtcccg

SEQ ID NO: 354128 - DNA, 684 bp, Homo sapiens
  misc_feature: GZ8MTXP02FJJPO.52.76.G10.1.454.CMB.2.raw
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctcgttgttcttttaagaggtgtccagtgtcaggtgcagctggtggagtcgtgggggaggcgtggtccaggcctggggacggtccctgagactctcctgtgcaggctctgctattcctcaataactatgctatcgatttgggccgccagctcccgaggtcaaggggtactgggacgttggggtgacaaggttaatactcgaaggctcggattaggggaggtcaaaccgttaaaaattcgtttaacccgataaggtaatttcgtgggacggaacggggggtcccaatttaccaacctagtactaaccccgaaggtaaacggaaacctaaacccaccccgaaaagtacttaacgtagtaacttaaactaaattacccttaaaccgtaaaaagttacggaaacctaacggacccttacggaaacgacccgttagggaacgggtaacccgacggggtaaccttaggttaacttacgtttaaccgtggttacgtccgggttacgggaacggggggtcctaaggtccgtcccggg

SEQ ID NO: 354129 - DNA, 751 bp, Homo sapiens
  misc_feature: GZ8MTXP02H98DB.52.76.G10.1.454.CMB.2.raw
  modified_base (230)..(230): a, c, t, g, unknown or other
  misc_feature (230)..(230): n is a, c, g, or t
  modified_base (241)..(241): a, c, t, g, unknown or other
  misc_feature (241)..(241): n is a, c, g, or t
tcagcgcagtacgacacgaccggtgctcgatttagtcactcatacagggcacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacngtcgatcaccntcctcctgcactggaaccagcaatgacgttggtacttataactctgtctctcggtaccaacaactaccccggacaaaccgtaccccaaactacatacgtatctttgacggtacagtgacgtccggccccggcgtacgggggtttctcgtacgttccgtccgtttccgtcccgggtacccttaccgtaaacgtcccgttcgggacgtaccggaccgacccgggtccccgttcccccgtacggaccctacttccgtccgttccggggcccgttacccggtacgggtaccgttacgggaaccggggtaaccggaacggggtcccgttaggtaaaccgttttaggtttaacctcgggtacctacggacctttacccaaacttaaaccaaaaccgtaaaaccgaaaacgtaaaaccgttaaccggttaagggggtttaccgggttacccgggggttaccgggggaaccccggggtaaacccgtaaaacccggttacccggtttaaaccccccggg

SEQ ID NO: 354130 - DNA, 693 bp, Homo sapiens
  misc_feature: GZ8MTXP02GMYV1.52.76.G10.1.454.CMB.2.raw
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaagtgacgttgtaacttatactctgtctctggtaccaacactaccccgacaaacgtccccaaactcatgtaattctttaggagtctaagtgtacgtccggcccggacgtacggggttttcctacgacttccgtccttccgtccggtccctacccgaacgttcgtacgggtccaacggcccgtacccgggtcccttaccccgtcgacctacttcgttccgtcgggtccgtccgaggcttacggaggacgagggtacctaggtaactttacttacgtcgacgtacgtctaactactaaccaaaacctaaaacgaaaccgaaacgtacggtttggggtacgttccggggaccggggtaccggtaaccgaaaacgtcgacccggttaccgtaaccgacgaaccgacccgaaggtccgtaacccgcccccgtaacggtccctaaccttccgtaacccggttacccccttaccccg

SEQ ID NO: 354131 - DNA, 605 bp, Homo sapiens
  misc_feature: GZ8MTXP02HLNM1.52.76.G10.1.454.CMB.2.raw
  modified_base (328)..(328): a, c, t, g, unknown or other
  misc_feature (328)..(328): n is a, c, g, or t
  modified_base (367)..(367): a, c, t, g, unknown or other
  misc_feature (367)..(367): n is a, c, g, or t
  modified_base (431)..(431): a, c, t, g, unknown or other
  misc_feature (431)..(431): n is a, c, g, or t
  modified_base (579)..(579): a, c, t, g, unknown or other
  misc_feature (579)..(579): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttgtacttatactctgtctcctggtaccaacaactaccccggacaaacgtccccaaactcatgatcttgaggtcagtgatcggccgctaggggtttcncgtactcgtcttcgtccggccctccgaagtctgcacgcnccggccctcctcgaccatctcgtcgggctcccgaggctggaggaccgaggctgtattagtacgngtacagtcctataactaaccaaacctaaaacaacgtaaaacgtacggttaggggttcggttcgggaccgggacggtaaaccctaacgtacgacccgttactaccgtaccgacgacccgaacggtccaaccggtcccccgtcggtaccnccttccggtacctttccccgaacccc

SEQ ID NO: 354132 - DNA, 549 bp, Homo sapiens
  misc_feature: GZ8MTXP02I604V.52.76.G10.1.454.CMB.2.raw
  modified_base (223)..(223): a, c, t, g, unknown or other
  misc_feature (223)..(223): n is a, c, g, or t
  modified_base (273)..(273): a, c, t, g, unknown or other
  misc_feature (273)..(273): n is a, c, g, or t
  modified_base (330)..(330): a, c, t, g, unknown or other
  misc_feature (330)..(330): n is a, c, g, or t
tcagcgcagtacgacacgaccggtgctcgatttagtcactcatacagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctctgcactggaaccngcaatgacgttgtacttatactctgtctctgtaccaacaactacccgganaaacgtaccccaaactcatgactctttgagtcagtgatcggcccgcgtagggtttcncactcgcttcctccggctacagtcgtgctgcacggcctccctgacctatctcgtggcctcgagctgacggacgagctgattattactgcagtctacataacaacaaacagtaacacgttgggtacgttcgggcgacggacaaacgtcgaaccgtcgttacgacgaccgacccgtaaggccctaccggtcccccgtaggtcccaacgttccgtttccccg

SEQ ID NO: 354133 - DNA, 618 bp, Homo sapiens
  misc_feature: GZ8MTXP02JEP17.52.76.G10.1.454.CMB.2.raw
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
  modified_base (447)..(447): a, c, t, g, unknown or other
  misc_feature (447)..(447): n is a, c, g, or t
  modified_base (486)..(486): a, c, t, g, unknown or other
  misc_feature (486)..(486): n is a, c, g, or t
  modified_base (496)..(496): a, c, t, g, unknown or other
  misc_feature (496)..(496): n is a, c, g, or t
  modified_base (582)..(582): a, c, t, g, unknown or other
  misc_feature (582)..(582): n is a, c, g, or t
tcagcgcagtacgacacgaccggtgctcgatttagtcactcatacagggggctctgggagacgagcccagcactggaagtcgccggtgtttccattcggtgatcatcactgaacacagaggactcaccatggagtttgggcagagctgggttctcctgttgttcttttaagaggtgtccagtgtcgaggtgcagctggtgagtcgtgggggagcgtggtccaggccgtgggagtcccgtgacgctctctgtgcaggctctgctacgtttcctanaaattacatcgctatcgtagtcggccncgtacggcctaccgaggtaccgaagggtctgggtagtggggtgacgtagtaatcgtacgagtctagagtacggacgtactaaacgttaaatacgttacgactaagtactttcggacgcgggtaacgggactaagttccaaacgttnactacccggagtaacgtaaaccaaccgtaaccgtaaagnttaaacggtntaacttaaaggtaaactacttaaaacgaagttacgaaactcgggaccttaagcgtaacctagggacgaccgagtactacgttaatntacgtgacggacgtcgggaaggttccaggctaccgg

SEQ ID NO: 354134 - DNA, 763 bp, Homo sapiens
  misc_feature: GZ8MTXP02IHL3J.52.76.G10.1.454.CMB.2.raw
  modified_base (253)..(253): a, c, t, g, unknown or other
  misc_feature (253)..(253): n is a, c, g, or t
  modified_base (299)..(299): a, c, t, g, unknown or other
  misc_feature (299)..(299): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctcgtgtctgggtcctcctggacagtcgatcaccatcctcctgcactaggaaccagcaattcgacgttaggtacttatactcgtntctctacgtaaccaacacgtacccgacaaacgaccccaactacatntattctttgacggtcagtgacgtccggcccgtcgtacggggtttcctacgtacgtacgtccttcgtcccggtcccttaccgtaaacgtccgtcgggcctacggaccgtacccggggtccctcccgtaccgaccgtaccgtccgtccgggtcggggtcccttccggaacgggtcgtacggggaacgggacggtacgggtctaacggttactttaacgttacgtcgacctaggtacctacgttaaccaaacgaaaccgaaaaacgtaaaccgtaaaccgttaacgggttttgggggtaccggggtttaccggggaaccgggggtaaccgggtaaccccgtaaaacgggtcccggtaaaccccgttaccggtaaaccgttccggaaaccgacccgggtaaccgtcccgtaaccccggtccccgttaccggtacctacccgttccctaccggttaccccctacccccg

SEQ ID NO: 354135 - DNA, 676 bp, Homo sapiens
  misc_feature: GZ8MTXP02GE2M5.52.76.G10.1.454.CMB.2.raw
  modified_base (203)..(203): a, c, t, g, unknown or other
  misc_feature (203)..(203): n is a, c, g, or t
  modified_base (276)..(276): a, c, t, g, unknown or other
  misc_feature (276)..(276): n is a, c, g, or t
tcagcgcagtacgacacgaccggtgctcgatttagtcactcatacaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccntctcctgccactggaaccagcaatgacgttggtacttatactctgtctcctggtaccaacaactaccccgganaaacgtccccaaactcatcgtatctttagagtcagtgacgtcggccgcgtacggggtttactcgtatccgtcttaccgtcccggtccctaccgaagtcgtacggtcacgccgaccggtcctacccgtcacctacttcgtcgtcgggccttcgaggcgtaggacggacgaggtctaggtaactttacgtacgtcaccgtaggtaccacttaaccgaaaccgaaactaaaaccgtaacgaaaaccgttcgtttacggggtcggttacgggaccgggtaaccggaaccgtaaaccgtaccggtacccttaccggtaccgtaccgaaccgacccgtaacgtacccgtcccggtcccccgtacggtaccctaccgttccggtaccccttacccccgtttaacccg

SEQ ID NO: 354136 - DNA, 694 bp, Homo sapiens
  misc_feature: GZ8MTXP02GZLPB.52.76.G10.1.454.CMB.2.raw
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (279)..(279): a, c, t, g, unknown or other
  misc_feature (279)..(279): n is a, c, g, or t
tcagcgcagtacgacacgaccggtgctcgatttagtcactcatacagggcacgaccggtgctcgatttagtcactcatacagggggctggggtctcaggaggcagcgctctcgggacgtctccaccatggcctgggctctgctattcctcaccctctcactcagggcacgagggtcctgggcccagtctgccctgacctcagcctgcctcgtgtctcgggtctaccgtggacagtcgatcacatctcngcactgacngcatgacgtgtactanactntntctcgtagtaccaacacaccccggacaaacgtaccccaaactcatgtactcgtttagacgttacagtgacgtcggtacccgtgtacgggggtttctacgtaacgttccgtccgttaccgtcccggtaccttaccgaaacggttcccgtacgccgtaacggacccgtacccggtacccgtcccgttacgaaccgtacgttccgtccggtaccggtccgtaccggtacgtcgtacgggacggaccgttacggcgttagtacgttaccgttacgacggtacctacgtacgtactaacgttaaaccaaaaccgttaaaaccgaaacggttaaacctaaccggggttcgggtacgggtttaacccggggaccgggttaaaccggaacccgttaaaaccggtaccggtttaaaacccccgg

SEQ ID NO: 354137 - DNA, 531 bp, Homo sapiens
  misc_feature: GZ8MTXP01C8YJP.41.75.G09.1.454.CMB.2.raw
  modified_base (250)..(250): a, c, t, g, unknown or other
  misc_feature (250)..(250): n is a, c, g, or t
  modified_base (427)..(427): a, c, t, g, unknown or other
  misc_feature (427)..(427): n is a, c, g, or t
  modified_base (475)..(475): a, c, t, g, unknown or other
  misc_feature (475)..(475): n is a, c, g, or t
  modified_base (484)..(484): a, c, t, g, unknown or other
  misc_feature (484)..(484): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggagcccagccaggttcagcggcagtggttctgggacacatttcactctcaccatcagcagcctgcccagctggagatttcgacgtaacttattactgaccaaactaattattcttttttatccgttactagttttggccgaggggaccaagctagganatacgaaagaactgggtgctgacaccatctgtcttctactccttcccnctaatcttntattatatacttgttcgttgtaagcgggtcgtggcaggccgaagaag

SEQ ID NO: 354138 - DNA, 536 bp, Homo sapiens
  misc_feature: GZ8MTXP01AUHU4.41.75.G09.1.454.CMB.2.raw
  modified_base (250)..(250): a, c, t, g, unknown or other
  misc_feature (250)..(250): n is a, c, g, or t
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttcnggatccactttgaagagtggancccagccaggtcagcggcagtggttcngggacactatttcactctcaccatcagcagcctgccagctgganatttcgcgtaattatacngaccctaataattatttactttttatccgttactagttttcggccgtaggggtaccaaggtctaggagatacgaaagtactaggggtggctgcacagtctgttccttctacttcctcccgcctaatcttgtattgtatacttgttcttgtaaggcgggctggcgaggtcgcgaag

SEQ ID NO: 354139 - DNA, 648 bp, Homo sapiens
  misc_feature: GZ8MTXP01D0609.41.75.G09.1.454.CMB.2.raw
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggactttttttggccttggtttcagcaggagcctggcaaacgcccctaagtccctgtattcttttctggacttccacttttggaagaggtggacgtccccagccaggttcaggcggcaggtggttctgggacactatttcactctcaccatcagcagcctgccagcgtggactagtttccgacgtaacttattacctgaccctaaactaattactttacttttttactccgttactaggtttcggccgaaggggtaacctaaggtcgttagggagtaatacgaaaaggtaccgttggggtcggtctcgacctacccgttaagtttcggttaccttactactttcccgttccccgtcctaattccgttattactttaacttacgtttaacgttcgttaccgttgggacgggtccgggggttcgtaacggggtacccgaagggggacctaacgaaggtaag

SEQ ID NO: 354140 - DNA, 642 bp, Homo sapiens
  misc_feature: GZ8MTXP01ERJC1.41.75.G09.1.454.CMB.2.raw
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagcccagccaggttcagcggcagtggttctggggacacatttcactctcaccatcagcagcctgccagctggatatttcgcgtaactttattactgaccctaaactaattactttacttttttactacccgttaacttacggttttcgggacccgtaaggggggtaaccccaaagggtcctagggaagaataccgaaaagggtaaccgttggggtcggggtcttcggacctacctattccttcgttcctttcctaacctttccctttccccgcctaacttccttaggtatttaagtaactttaacgttcggttccgttagggtaacgggccgggggtcgttcgggggaccgaaggggtcccggaacgtaag

SEQ ID NO: 354141 - DNA, 605 bp, Homo sapiens
  misc_feature: GZ8MTXP01ECV1U.41.75.G09.1.454.CMB.2.raw
  modified_base (255)..(255): a, c, t, g, unknown or other
  misc_feature (255)..(255): n is a, c, g, or t
  modified_base (312)..(312): a, c, t, g, unknown or other
  misc_feature (312)..(312): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaagcccctaagtccctgattcttttcngattccactttgaagagtggagtcccagccaggttcagcggcagtggttctgggacncatttcactctcaccatcagcagcctgcccagcctggagatttcgcgtaactttatactgaccaactaatatttcttttttactccgtttactacgttttcggaccgtaggggaacccgaaggtctacgggagtaactacgaaagggaacgttgggtcggtctgacctacctatcttcgttacctttctacttcccttcccgtcctaacttccttagtaacttacgttattacgttcgttcgttacgggaacggccgggtcgttcggggtacccgaagggtccgaacggtaag

SEQ ID NO: 354142 - DNA, 738 bp, Homo sapiens
  misc_feature: GZ8MTXP01EO294.41.75.G09.1.454.CMB.2.raw
  modified_base (256)..(256): a, c, t, g, unknown or other
  misc_feature (256)..(256): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagcctggacaaacgcccctaagtccctgtattcttttcnggactcctactttgaagaggtggacgtcccagcctaggttcaggcggctaggttggttcgtgggacactacttcactctcacatcagcagcctgcccagcgtaggatacgtttccgacgttaactttacttacctcgaaccctaaactttaaacttacttttaccttttttacgtccgtttaacgttacgggttttacgggacccggtaacgggggtaacccctaaaggtccgtaggggtaacgtaacgtaaacggtaaaacggggtaaccgttagggggtcgggtaccgttacggaaccctaacctaacgttccgtttacggtttaccctttaccgttacctttccccggtttaccccgacccttaactttaccgttagtaactttaaacgttaacttaacgttcggtttcggttaacggggtaacggggtccgggggtaaccgtacgggggacccggaaacggggttcccgaacggtaag

SEQ ID NO: 354143 - DNA, 601 bp, Homo sapiens
  misc_feature: GZ8MTXP01C4ZAJ.41.75.G09.1.454.CMB.2.raw
  modified_base (299)..(299): a, c, t, g, unknown or other
  misc_feature (299)..(299): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagctggcaaagcccctaagtccctgattctttctggatcactttgaagagtggagtcccagccaggtcagcggcagtggttcngggacacatttcactctcacccatcagcagcctgccacgctggacgtactttcgacgtaactttatactcgaccaactactttattccttttttactacccgttacgtaggttttcggaccgtaacgggggaacctaaggcgttagggaaagagtaacgaaaagggtaaccgttggggtcggcgttacgacctaccgtaattctcgttacctttcaccttcccttcccgacctaacttccttagtacttacttacgtcttacgttcgttagcggtcggcgtcgggacgacgggtcgcgtaag

SEQ ID NO: 354144 - DNA, 726 bp, Homo sapiens
  misc_feature: GZ8MTXP01DQBHS.41.75.G09.1.454.CMB.2.raw
  modified_base (255)..(255): a, c, t, g, unknown or other
  misc_feature (255)..(255): n is a, c, g, or t
  modified_base (274)..(274): a, c, t, g, unknown or other
  misc_feature (274)..(274): n is a, c, g, or t
  modified_base (313)..(313): a, c, t, g, unknown or other
  misc_feature (313)..(313): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggcctggtttcagcaggagctggacaaacgcccctaagtccctgtattcttttcnggacttccactttggaagngtgacgtcccagccaggttcaggcggcaggttggttcgngggacactatttcactctcaccatcagcacgctgccagcgtggatacttaccgacgtaactttattacctagaccctaaactaatttacttttacctttttttacgtaccgtttaacgttaaggtttttcgggacccggtaaacgggggtaaccctaaaggtccgttaggggaagtaaacgttaaccggaaaaagggtaaccgtttgggggttaaccggtcgttaccggaccgtaaacctacgtttccgttcgtttaacctttccgtaaccctttcccctttcccccggtaacccttaagttaccttacggttaaactttaaacgtttaaagttaccctttaggttccggtttaagggaaccggggttacgggcccggttagggaccggttaaacggggccgttaacggtaag

SEQ ID NO: 354145 - DNA, 506 bp, Homo sapiens
  misc_feature: GZ8MTXP02JXDW2.41.75.G09.1.454.CMB.2.raw
  modified_base (423)..(423): a, c, t, g, unknown or other
  misc_feature (423)..(423): n is a, c, g, or t
  modified_base (504)..(504): a, c, t, g, unknown or other
  misc_feature (504)..(504): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctggggacacatttcactctcaccatcagcagcctgccagcctggagatttcgcgtacttattactgcccaaacaatatctttttatccgttacagttttgcctaggggacccaagctagganatcaaaaggactagtgctgcaccatctgtcttcatcttccgcctactctgatatatactgtctgaagcggctggcaggcgnag

SEQ ID NO: 354146 - DNA, 519 bp, Homo sapiens
  misc_feature: GZ8MTXP02FTWRD.41.75.G09.1.454.CMB.2.raw
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatctttctggatccactttgaagagtggagtcccagccaggttcagcggcagtggttctgggacacatttcactctcaccatcagcagcctgccagcctggagtatttcgcgtacttattactcgacctaaataattattctttttatccgttactagtttggaccaggggacccaagctaggagatacgaaaggactggtgctgacacacttctgtcttcactctccgctactctagactatactactgtctgaagcggctcggcgaacggcgaca

SEQ ID NO: 354147 - DNA, 548 bp, Homo sapiens
  misc_feature: GZ8MTXP02GTP17.41.75.G09.1.454.CMB.2.raw
  modified_base (358)..(358): a, c, t, g, unknown or other
  misc_feature (358)..(358): n is a, c, g, or t
  modified_base (401)..(401): a, c, t, g, unknown or other
  misc_feature (401)..(401): n is a, c, g, or t
  modified_base (459)..(459): a, c, t, g, unknown or other
  misc_feature (459)..(459): n is a, c, g, or t
  modified_base (498)..(498): a, c, t, g, unknown or other
  misc_feature (498)..(498): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggacaaacgcccctaagtccctgattctttctggatcctactttgaagagtggacgtcccagcctaggtcaggcggcaggtggtctgggactactatttcactctcaccatcagctagcctgccagcctggagtnttccgcgtacttatactcgaccaataattactttctttttacnccgttactagtttcggaccgtagggtacccagtcgtaggagataacgaaaggtactgngtactgcactagtctgtctctacttcctccgctactctntacttatactactcgtacgtgaacggtcggacgtcggacgacggcgacag

SEQ ID NO: 354148 - DNA, 661 bp, Homo sapiens
  misc_feature: GZ8MTXP02GH7AA.41.75.G09.1.454.CMB.2.raw
  modified_base (260)..(260): a, c, t, g, unknown or other
  misc_feature (260)..(260): n is a, c, g, or t
  modified_base (310)..(310): a, c, t, g, unknown or other
  misc_feature (310)..(310): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgactattaggtactttttttggccttggtttcagcaggagcctggacaaacgcccctaagtccctgtacttcttttcnggactccactttgaagagtggagtcccagcaggtcagcggcaggtggtcngggacactattcactctcaccatcagcagcctgccacgcctggagtactttcgcgtactttagtactcgtacctaaactaattactttactttttttaacgtcccgtttaacgttaggtttttcggacccggtaacgggggtaccctaacggtccgttagggacgtagtaaccgaaaagggtaacctaggtcggtcgttcggaccgtaaccgtaacttcgttacgtttcctttactacctttcccctccccgtcctacttacccggttattaaaccttaattactttaacccgtgttaccgtgggtaacggtcggggtccgttacggggacggtacgggaccggactaagg

SEQ ID NO: 354149 - DNA, 714 bp, Homo sapiens
  misc_feature: GZ8MTXP02HYL1M.41.75.G09.1.454.CMB.2.raw
  modified_base (437)..(437): a, c, t, g, unknown or other
  misc_feature (437)..(437): n is a, c, g, or t
tcagtctatactatcacgaccggtgctcgatttagtatagacatcagggacttaggggctttgccaggctcctgctgctctgtttccccggtgccaggtgtgacatcgagatgacccagtctccgtcctcactgtctgcgtctattggggacagagtcaccatcacttgccgggcgagtgccgacattaggtacttttttggccttggtttcagcaggagcctggcaaacgcccctaagtccctgattcttttctggtactcctactttgaagtagtggacgtcccagccaggttcagcggacgaggttggtcgtggggacacgtacttccacttctaccacccatacagcacgcctgccgacgtcccgtggaacgttagtttccggacgtactttattactacgaccctaaataactttacttttactttttaacnccgttacgttaacggtttcgggacccggtaacggggtaaccctaaggtaccgttaaggggaactaacgtaaacgtaaaaaacgggtcgtttacggtacggtcgttacggacccaaaaccgtcttacgttacgtttaacttcgtaaccgtttcccctacccggacccttaatccggtaaagttaaccgttaagtttaaaactttcccgttaggtacgttaacgggaacggtaccgggggtacttacgggggaccgtaaaacgggtcggtaacctaagg

SEQ ID NO: 354150 - DNA, 498 bp, Homo sapiens
  misc_feature: GZ8MTXP01D7IVQ.13.8.A08.1.454.CMB.2.raw
  modified_base (214)..(214): a, c, t, g, unknown or other
  misc_feature (214)..(214): n is a, c, g, or t
  modified_base (446)..(446): a, c, t, g, unknown or other
  misc_feature (446)..(446): n is a, c, g, or t
tcagtcacgtactacacgaccggtgctcgatttagcatactctacagggggagtcagtctcagtcaggacacagcatggacatgagggtcccgctcagctcctggggctcctgctactctggctccgaggtgccatatgtgacatccagatgacccagtctccatcctccctgtctgcatctgtaggagacagagtcaccgtcacttgccgggnaagtcagaccattgacaaatatgtaaatggtatcaacagaagccaggtgaagcccctaagctcctgatctatactgcatcccatttgcaggcggggtcccatccaaggttccgtggcagtgggatcgtgggacagatttcactctcaccatcacagtctgacaacctgaagactgtgactaacttactaactgaccaacagtcttacggaacctacgtactactttggccgnggggaaccaggctggagatacaaacgacttagtggctcgcaccatcttgttc

SEQ ID NO: 354151 - DNA, 549 bp, Homo sapiens
  misc_feature: GZ8MTXP01DTOI0.13.8.A08.1.454.CMB.2.raw
  modified_base (214)..(214): a, c, t, g, unknown or other
  misc_feature (214)..(214): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacgtcatttgccggnaagtcagaccattgaacaaatatagtaaattggtatacaaacagaagccaaggtacgaaacgccccctaaagcctacctgatactatactgacatccctactttgtcgacgggccggggtacccatacccgtaacggttcgtggcaggtggatcgtgtagactatatttcactctacaccatcacctatctagacaacctgaacactgtacactaacgttactactcacctaactacgttaccttaacggaaccttcgtacttaccgtttcggccggaaggggacccaggcgttggagtagacaacgaacgtaagtggtcgcacactaacttctc

SEQ ID NO: 354152 - DNA, 508 bp, Homo sapiens
  misc_feature: GZ8MTXP01B82F7.13.8.A08.1.454.CMB.2.raw
  modified_base (204)..(204): a, c, t, g, unknown or other
  misc_feature (204)..(204): n is a, c, g, or t
  modified_base (215)..(215): a, c, t, g, unknown or other
  misc_feature (215)..(215): n is a, c, g, or t
  modified_base (390)..(390): a, c, t, g, unknown or other
  misc_feature (390)..(390): n is a, c, g, or t
  modified_base (466)..(466): a, c, t, g, unknown or other
  misc_feature (466)..(466): n is a, c, g, or t
  modified_base (480)..(480): a, c, t, g, unknown or other
  misc_feature (480)..(480): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtnacttgccgggnaagtcaagaccattgacaaatatgtaaattggtatcaacagaagccaggtgaagcccctaaagctcctgatctatactgcatccactttgtcaggcggggtcccatccaaggtcgtggcagtgatctgggacagatttcactctcaccatcacagtctgacaacctgaagctgtnacaaacttactactgacccaacagtacttaacggaacctacgtactaactttggcctaggggaaccaggctagganagtcaaaacgttangtaaggctcgctacccattccttgttcc

SEQ ID NO: 354153 - DNA, 503 bp, Homo sapiens
  misc_feature: GZ8MTXP01DW3UO.13.8.A08.1.454.CMB.2.raw
  modified_base (215)..(215): a, c, t, g, unknown or other
  misc_feature (215)..(215): n is a, c, g, or t
  modified_base (332)..(332): a, c, t, g, unknown or other
  misc_feature (332)..(332): n is a, c, g, or t
  modified_base (393)..(393): a, c, t, g, unknown or other
  misc_feature (393)..(393): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgacaaatatgtaaattggtatcaaacagaagccaaggtgaaacgcccctaagctcctgatctatactgcatcctactttgcaggcgggtccatccaaggttcgngcaggtgatcgtgggacagtatttcactctcacatcacagtctgacaacctgaagactgtnactaacttactactgacccaaacacgttctaaccggaacctacgtactactttgccgaggggaaccaggctggagatacgaaacgacttgtggctcgcaccatcttgtcc

SEQ ID NO: 354154 - DNA, 576 bp, Homo sapiens
  misc_feature: GZ8MTXP01BA7FH.13.8.A08.1.454.CMB.2.raw
  modified_base (215)..(215): a, c, t, g, unknown or other
  misc_feature (215)..(215): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgacaaatatgtaaattggtatcaacagaagccaggtgaagcccctaagctcctgatttatactgcatccactttgtcaggcgggtccatcaacggttccgtggcagtggaatcgtgggactagatttcactctcaccatcaccagtctagcaaacctgaaagactgtcgactaaactttactacgtgacccaaacgtacgttaccttaaccggaaacccttcggtaacctacgttttcgggacccgaagggggacccaagggtccttagggaacgttacgtacgaaaaaccggttacgttggttacgggccttggaaccaacccgtattcccttggttcctttaaccg

SEQ ID NO: 354155 - DNA, 599 bp, Homo sapiens
  misc_feature: GZ8MTXP01CHX4L.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccggcaagtcagaccattgaacaaatatagtaaattggtatacaacagaagccaggtgaacgcccctaagctcctgatctatactgcatcctactttgcaggcgggtccatccaggttcgtggcagtgatcgtgggacagtattcactctcacatcacagtctagacaacctgaacgactgtagactaaactttactacgtcgaccaaacgtacgttaccgttaaccggtaaccttaccggttaaccttaaccgttttcgggacccgtaacggggggaacccctaaggggttcccgttaaggggaacgtaaactaaccgttaaaaaccggttaaccgttagggttcgggaccttaacggacccacccgttaagttccgtttcgtttccc

SEQ ID NO: 354156 - DNA, 488 bp, Homo sapiens
  misc_feature: GZ8MTXP01ETNCS.13.8.A08.1.454.CMB.2.raw
tcagtcacgtactacacgaccggtgctcgatttagcatactctacaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgcaggcggggtcccatccaaggttcgtggcagtggatcgtgggacagatttcactctcaccatcacagtctgcaacctgaagactgtgacaacttactactgaccaacagtcttacggacctcgtactactttggccaggggccaggctggagatacaaacgacttgtggctgcaccatccttgtcc

SEQ ID NO: 354157 - DNA, 515 bp, Homo sapiens
  misc_feature: GZ8MTXP01DVV0C.13.8.A08.1.454.CMB.2.raw
  modified_base (215)..(215): a, c, t, g, unknown or other
  misc_feature (215)..(215): n is a, c, g, or t
  modified_base (396)..(396): a, c, t, g, unknown or other
  misc_feature (396)..(396): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgaacaaatatgtaaattggtatcaaacagaagccaggtgaagcccctaagctcctgatctatactgcatcctactttgcaggcgggtccatccaaggttcgtgcagtgatcgtgggactagtatttcactctcacctatcacagtctgactaacctgaaacgcttgtnacaactttacgtactgaccaaactagtccttaacggaacctcgtactacgtttcggaccgaggggaaccaggctaggacgatacaaacggttacttggtgctgcacgactcttaagtcc

SEQ ID NO: 354158 - DNA, 516 bp, Homo sapiens
  misc_feature: GZ8MTXP01A6ICJ.13.8.A08.1.454.CMB.2.raw
  modified_base (190)..(190): a, c, t, g, unknown or other
  misc_feature (190)..(190): n is a, c, g, or t
  modified_base (204)..(204): a, c, t, g, unknown or other
  misc_feature (204)..(204): n is a, c, g, or t
  modified_base (329)..(329): a, c, t, g, unknown or other
  misc_feature (329)..(329): n is a, c, g, or t
  modified_base (395)..(395): a, c, t, g, unknown or other
  misc_feature (395)..(395): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtnacttgccgggcaagtcagaccattgaacaaatatgtaaattggtatacaaacagaagccaggtgaagcccctaagctcctgatctatactgcatccatttgtcaggcggtccatccaaggttcgnggcagtggatcgtgggacagtatttcactctcaccatcacagtctgacaacctagaacgactgtanactaacttaacgtaactgaccaaacacgtacttaacggaacctacgtactacgttttcgccgagggaaccaaggcgtggagaagtacaaacgacttgtaaggctaagcaccatccttgttc

SEQ ID NO: 354159 - DNA, 553 bp, Homo sapiens
  misc_feature: GZ8MTXP01DOMU2.13.8.A08.1.454.CMB.2.raw
  modified_base (352)..(352): a, c, t, g, unknown or other
  misc_feature (352)..(352): n is a, c, g, or t
  modified_base (405)..(405): a, c, t, g, unknown or other
  misc_feature (405)..(405): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgaacaaatatgtaaattggtatcaacagaagccaaggtgaaacgcccctaagcctcctgatctatactgcatccctatttgcgacggcgggtccatccgaaggttcgtggctaggtggatcgngggacagtatttcactctcacatcacagtctgactaacctagaacgactgtanactaaacttacgtaactcgacccaaacgtacgttaccgttaacggtaaccgttaccgttactacgttttacggacccgtaggggaaccgtacgggcgtaggaagtacgtacgaaacgttacgttgtggctgcacttactcttcgttcc

SEQ ID NO: 354160 - DNA, 566 bp, Homo sapiens
  misc_feature: GZ8MTXP01D7A2J.13.8.A08.1.454.CMB.2.raw
  modified_base (216)..(216): a, c, t, g, unknown or other
  misc_feature (216)..(216): n is a, c, g, or t
  modified_base (394)..(394): a, c, t, g, unknown or other
  misc_feature (394)..(394): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgaacaaatatgtaaattggtatacaacagaagccaggtagaaacgcccctaagctcctgatctatactgcatcctatttgcaggcgggtccatccgaaggttcgtggcagtggatcgtgggacagtatttcactctcacatcacagtctgacactgaagactgtnactaacttacgtactcgaccaaactacgtaccttaaccggaaccttacgtacctacgttttacggaccgtacggggaaccagggccgtagggaacggtaaacttaacgaaaacggttaaaccgttggttaacgggcttaacggaccaaccttacgtttccttcgtttaaccc

SEQ ID NO: 354161 - DNA, 529 bp, Homo sapiens
  misc_feature: GZ8MTXP01BBG91.13.8.A08.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggnaagtcagaccattgacaaatatgtaaattggtatcaacagaagccaggtgaacgcccctaagctcctgatctatactgcatcccatttgcaggtccgggtccagtccgaaggttccgtggcaggtggatcgtgggacagtatttcactctcaccatcacagtctgacaacctagaacgactgtagactaaactttactaactcgacccaacgtagtaccttaaccggaccttacgtactacgtttcggccgtaggggaaccaggcgtggacgtatacgaaacgttacgttgtggctcgcacttatcgttgtcc

SEQ ID NO: 354162 - DNA, 559 bp, Homo sapiens
  misc_feature: GZ8MTXP01ET5UP.13.8.A08.1.454.CMB.2.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (341)..(341): a, c, t, g, unknown or other
  misc_feature (341)..(341): n is a, c, g, or t
  modified_base (548)..(548): a, c, t, g, unknown or other
  misc_feature (548)..(548): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccggnaagtcagaccattgacaaatatagtaaattggtatcaacagtaagccaggtgaacgcccctaagctcctgatctatactgcatcctattttgcgaggtccggggtcccagtcccgaaggtttccgnggcaggtgggatcgtagggacagtatttcactctcacatcacagtctgaccaacctgaacactgtacactaacttacacgttcgaccaactacgttaccgttaaccggtaacccttacggtacctacgttttacgggacccgagggggaacccagggttccgtagggagtactaaccgaaacgttcttggtcggactcgccaccttnttccgttcgtc

SEQ ID NO: 354163 - DNA, 577 bp, Homo sapiens
  misc_feature: GZ8MTXP01AVY0B.13.8.A08.1.454.CMB.2.raw
  modified_base (205)..(205): a, c, t, g, unknown or other
  misc_feature (205)..(205): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtnacttgccgggcaagtcagaccattgaacaaatatagtaaattggtatacaaacagaagccaaggtgaacgcccctaagctcctgatctatactgcatcctatttgcagggcgggtccatccgaaggttcgtggcagtagatcgtagggacagtattcactctcaccatcacagtctgaccactgaagactgtagactaacttactactcgaccctaaacgacgttaccgttaaccggaacctttacgtaaccgttaccgttttacgggacccgtaacgggggaacccagggccgttagggaactaacgttaaccgaaaacggttaaccttgggtaacggcctcggaccacccgttattccgttaagtttccc

SEQ ID NO: 354164 - DNA, 486 bp, Homo sapiens
  misc_feature: GZ8MTXP01EVSMZ.13.8.A08.1.454.CMB.2.raw
tcagtcacgtactacacgaccggtgctcgatttagcatactctacaggggagtcagtctcagtcaggacacagcatggacatgagggtcccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaatggtatcaacagaagccaggtgaaagcccctaagctcctgatctatactgcatccactttgtcaggcggggtcccatccaaggttcgtggcagtggatctgggacagatttcactctcaccatcaccagtctgcaacctgaagactgtgcaacttactactgccaacagtctacggaacctcgtactactttggccaggggaaccaggctggagatcaaacgacttgtggctgcaccatcgttgtc

SEQ ID NO: 354165 - DNA, 609 bp, Homo sapiens
  misc_feature: GZ8MTXP01A1LW6.13.8.A08.1.454.CMB.2.raw
  modified_base (216)..(216): a, c, t, g, unknown or other
  misc_feature (216)..(216): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattagaacaaatatagtaaattggtatacaacagaagccgaggtagaacgcccctaagcctcctagactctatactgctactcctacgtttgacgacgggtccggggtacccagttacccgtaacgggtttccgtggaccgtaggtacgggacttcgtaggggaactagtactttccactctcaccataccactagtctagaccaactagaagacgtgtacgtactaaccttactacgtacgaacctaacgtacgttaccgttaaccgaacccgttacgtacgttacgtttacggccgtaacggggaacccgaggttccgtaggacgtaactaacgaaacggttacgttcggtaaggctcgaccacgttactcttcgttaacc

SEQ ID NO: 354166 - DNA, 599 bp, Homo sapiens
  misc_feature: GZ8MTXP01EQYJR.13.8.A08.1.454.CMB.2.raw
  modified_base (217)..(217): a, c, t, g, unknown or other
  misc_feature (217)..(217): n is a, c, g, or t
  modified_base (350)..(350): a, c, t, g, unknown or other
  misc_feature (350)..(350): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccggganaagtcagaccattgaacaaatatagtaaattggtatacaacagaagcaaggtcgaaacgcccctaagctcctagtactctatactgctactccctacgtttgtcgagggccggggtaccatccaaggttccgnggcaggtgatcgtagggacagtactttcactctacaccataccgacagttcagtaccaacctagaacgtactcgactaacctaaacttacggtactacggaacctaaacgacgtttcctaaaccggtaacccttaccgttaaccttacggtttcgggaccgaacggggaaccgttaaggccggtagaagaactaacgaaaacgttacgttggaagtccgtaaggacctcttacttcgtttcgttaaccc

SEQ ID NO: 354167 - DNA, 505 bp, Homo sapiens
  misc_feature: GZ8MTXP01EE7YD.13.8.A08.1.454.CMB.2.raw
  modified_base (203)..(203): a, c, t, g, unknown or other
  misc_feature (203)..(203): n is a, c, g, or t
  modified_base (397)..(397): a, c, t, g, unknown or other
  misc_feature (397)..(397): n is a, c, g, or t
  modified_base (419)..(419): a, c, t, g, unknown or other
  misc_feature (419)..(419): n is a, c, g, or t
tcagtcacgtactacacgaccggtgctcgatttagcatactctacagggggagtcagtctcagtcaggacacagcatggacatgagggtcccgctcagctcctggggctcctgctactctggctccgaggtgccagatgtgacatccagatgacccagtctccatcctccctgtctgcatctgtaggagacagagtcaccgtnacttgccgggcaagtcagaccattgacaaatatgtaaatggtatcaacagaagccaggtgaagcccctaagctctgatctatactgactatccactttgtcaggcgggtcccatccaaggttcgtggcaggtcgatcgtagggactagatttcactctacaccatcaccagtctgacaaacctgaagtactgtnactaacttactactgaccaacngttactacggaacctcgtactactttcggcctaggggaaccaggctggagactacaaacgagttgtcggatgacaccatcttgttc

SEQ ID NO: 354168 - DNA, 610 bp, Homo sapiens
  misc_feature: GZ8MTXP01C2COS.13.8.A08.1.454.CMB.2.raw
  modified_base (218)..(218): a, c, t, g, unknown or other
  misc_feature (218)..(218): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttggccggganaaagtcagaccattgaacaaatatagtaaattggtatacaacagaagccaaggtacgaaacgcccctaagcctcctagactctatactgacatccctactttcgtcgacgggcgggtccagtcccgtaaggttccgtggcagtgggatcgtgggaactagtattcactctacactatcacagtctacgactaacctagaaacgtactagtacaactaacctttacgtaacttacgaaccctaaacgttacgttacccgtttaacccggtaacctttaccgttaaccttaccggttttacgggacccggtaaggggaacccgtgggacgttagggaataacgtacgaaaacggcgttacggtcggctaacgcctacttacttcgttcgtttcc

SEQ ID NO: 354169 - DNA, 557 bp, Homo sapiens
  misc_feature: GZ8MTXP01DYI70.13.8.A08.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (349)..(349): a, c, t, g, unknown or other
  misc_feature (349)..(349): n is a, c, g, or t
  modified_base (402)..(402): a, c, t, g, unknown or other
  misc_feature (402)..(402): n is a, c, g, or t
  modified_base (542)..(542): a, c, t, g, unknown or other
  misc_feature (542)..(542): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggnaagtcagaccattgaacaaatatagtaaattggtatacaacagaagccaggtgaacgcccctaagcctcctgatctatactgcatcctactttgcgaggccgggtccatccgaaggttcgtgctagtgatcgngggacagtacttcactctcacatcactagtctagacaacgtgaacgactgtanactaaaccttacgtaacttcgaccaaacgtacgttaccgttaaccggtaaccttacggttacttacggtttacggaccgtaagggggaacctaggcgtaggagtaactacgaaaacgcgttgaaggtactgaccaccttnttcccgttgtttccc

SEQ ID NO: 354170 - DNA, 576 bp, Homo sapiens
  misc_feature: GZ8MTXP01C35I7.13.8.A08.1.454.CMB.2.raw
  modified_base (215)..(215): a, c, t, g, unknown or other
  misc_feature (215)..(215): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacttgccgggnaagtcagaccattgaacaaatatagtaaattggtatcaacagaagccaggtgaacgcccctaagctcctgatctatactgcatcctacttgtcaggcgggtccagtcccaggttcgtggcagtgatcgtgggacagtattcactctcacatcacagtctgacaacctagaacgactgtacgtactaacttactaacctacgacccaaacgtacgttaccgttaaccggtaaccttaccgttaacttaccgttttacgggacccgtaacgggggtaaccgagggttccgtagggaacgtaacgtaacgaaaaccggttacgttacggtcgggctcggacctaccttacttcgttcgtttccc

SEQ ID NO: 354171 - DNA, 563 bp, Homo sapiens
  misc_feature: GZ8MTXP01AKTTW.13.8.A08.1.454.CMB.2.raw
  modified_base (403)..(403): a, c, t, g, unknown or other
  misc_feature (403)..(403): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccgtcacttggccgggcaagtcagacctattgaacaaatatagtaaattggtatcaacagaagccaggtgaacgcccctaagctcctgatctatactgcatcctactttgcgacgggccggggtccatccgtaacgggttccgtggctaggtggatcgtagggacagtatttcactctacacatcacagtctgacactgaanctgtagactaacttacgtactcgaccaactagtacctaacgaccttaccggtactacgtttcggccgtacggggaacagggttcgtacggaagaactaaccgaaacgaccgttggtcgggaccttcgacccgtaccttacgttccgttaacgttttcccg

SEQ ID NO: 354172 - DNA, 610 bp, Homo sapiens
  misc_feature: GZ8MTXP01EOCHN.13.8.A08.1.454.CMB.2.raw
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtnacttgccggnaagtcagaccattgaactaaatatagtaaattggtatcaaacagaatccaaggtgaaacgcccctaagctcctgatctatactgctatccctatttgcaggcgggtcccatccgaggttcgtagcagtggatcgtgggacagtatttcactctacacatcaccagtctacgactaacctgaacgtactgtagactaacttacgtacttcgacctaacgtacgttaccgttaaccgggtaacccttacggtaaccttaccggtttttaccggacccggtaacgggggtaacccgaaggggttccgtacggggaaataaacgttaaccgaaaaaccggttacgttgggtaaccggggtcttaaccggccaacccgttagttccgttcgttttccccg

SEQ ID NO: 354173 - DNA, 672 bp, Homo sapiens
  misc_feature: GZ8MTXP01DTB3X.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtcctccatccctccctgtctgcatctgtaggagacagagtcaccgtcacttgccgggacaagtcagaccattgaactaaatatagtaaattggtatacaaacagaagccaaggtagaacgcccctaagcctcctgatctatactgctactccctacgtttcgtacgacgggtccggggtcccagttacccgaacgggtttccggagggtacgtagggtagggtaacttcggtagggggaaacctaggttaacttttccgaacccttcctacccaaccctaacttacccgaaccctaaggttccttacggaaccctaaacccgttaaggaaacggtaaccttgggtacgtaacctaaacctttaacgtaacttaccgaaccctaaacgtacgttaccgttaaccggtaccttacgttacctacgtttcggaccgaacggggaaccaggttcgtaggaagtaactaacgttaaacgacttggtaacggctcgactaccttattcttcgttaacc

SEQ ID NO: 354174 - DNA, 647 bp, Homo sapiens
  misc_feature: GZ8MTXP01AKK4D.13.8.A08.1.454.CMB.2.raw
  modified_base (216)..(216): a, c, t, g, unknown or other
  misc_feature (216)..(216): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgaacaaatatagtaaattggtatacaacagaagccaggtagaacgcccctaagctcctgatctatactgcatcctactttgacgacgggtccggtacctagtaccgtacggttcgtggacgtaggtacgtacgttcggagggtaacgtagttacttacctacctcctacccacctactacccaaccgtacgtcctacggaaccctaaccgtaagaacgtacgtacgtacgtaacttaaccttacgtacgtacgtaaccctaacgtaccgttaccgttaaccgtaccgttacgtacctttacggttccggaccggacggggaacccgtggttaccggtaggaacgtaaacgtaaccgaaacgttacgttcgggtaacgtcgtaaccggacctaccgttacttccgttcgtttaaccccg

SEQ ID NO: 354175 - DNA, 601 bp, Homo sapiens
  misc_feature: GZ8MTXP01BS7HP.13.8.A08.1.454.CMB.2.raw
  modified_base (215)..(215): a, c, t, g, unknown or other
  misc_feature (215)..(215): n is a, c, g, or t
  modified_base (335)..(335): a, c, t, g, unknown or other
  misc_feature (335)..(335): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacgtcacttgccgggnaagtcagaccattgacaaatatagtaaattggtatcaacagaagccaggtgaacgcccctaagctcctgatctatactgcatcctatttgtcgaggcgggtcccagtcccgaaggttcgnggcaggtgatcgtgggactagtactttcgactctacaccatcacagtctcgacaaccgtagaacgtactgtacgactaaacctttacgtactacggtacccaaacgtacgttaccgttaaccggtaaccttaccgttaaccttaccgtttttacgggacccgtaacgggggaacccgtgggaccggttagggaacgaacgttaaccgaaaacggttaccgttaggtcgggtcctcgggacctacccttacttccggttcgtttccc

SEQ ID NO: 354176 - DNA, 669 bp, Homo sapiens
  misc_feature: GZ8MTXP01CKCCB.13.8.A08.1.454.CMB.2.raw
  modified_base (216)..(216): a, c, t, g, unknown or other
  misc_feature (216)..(216): n is a, c, g, or t
  modified_base (597)..(597): a, c, t, g, unknown or other
  misc_feature (597)..(597): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccgtcacttgccggnaagtcagaccattgaacaaatatagttaaattggtatcaacagaagccaggtgaaacgccccctaagcctcctgactctatactgctactccctagtttgtacgacgggcggggtcccagttcccgtaacgggtttccgtgggcctaggtacgggtaacttcggtagggggtaaacctaggttacttttccaaccttcctacccaaccctacttacccgaacctaacggttcctacggaccctaaacccgttagaaacgtccgttaggaccgtactaaacctttaaccgtacggttacgaaccctaaacgtacgtttacccttaaccgggtaaccttacggttaaccttaccggttttcggaccgggacggggtaacccgngggttaccgtaggagtaacgtaacgaaaccggagtttcgggcggtacctcgacctacttacgttcgttcgtc

SEQ ID NO: 354177 - DNA, 669 bp, Homo sapiens
  misc_feature: GZ8MTXP01D8VR9.13.8.A08.1.454.CMB.2.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (217)..(217): a, c, t, g, unknown or other
  misc_feature (217)..(217): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtnacttggccgggnaagtcagaccattgaacaaatatgtaaattggtatcaaacagaagccaggtgaaacgcccctaagctcctgatctatactgctatcctatttgcgacgggccggggtcccagttccgaacgggttcgtggacaggtagggaacttcggtgggaactaggttactttccacttctaccaacctattaccaaccgtacgttcctacggtaacctaaaccgttaggaaacgtaacttcggtactaacctaaacctttaacgtaaccgttacggtaaccccaaaactacggttaaccgttaaaccgggtaaaccctttaccggtaaaccttaccggttttacggggacccggtaacgggggtaacccaagggttccggtaggaacgtaaacgttaacggaaaaccgttacgttgggtaacgcgttaacgacctacttacttccgttcgtttaaccc

SEQ ID NO: 354178 - DNA, 553 bp, Homo sapiens
  misc_feature: GZ8MTXP01DN3NH.13.8.A08.1.454.CMB.2.raw
  modified_base (215)..(215): a, c, t, g, unknown or other
  misc_feature (215)..(215): n is a, c, g, or t
  modified_base (347)..(347): a, c, t, g, unknown or other
  misc_feature (347)..(347): n is a, c, g, or t
  modified_base (496)..(496): a, c, t, g, unknown or other
  misc_feature (496)..(496): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccggnaaagtcagaccattgaacaaatatagtaaattggtaatacaaacagaagccaaggtgaaacgccccctaaagcctcctgtatctaatactgctatccctatttgcgaggccggggtccatccgaaggttcgnggcaggtagatcgtgggactagtactttcactctacacatcacagtctcgacaacctagaacgactgtacgacctaaacttaactactagaccaacgtacgtaacttaaccggaacttacgtactacgtttcggaccgaaggggaaccnggcgtggaagtactaacgaaaaccgttattggtaaggctcgcacttatcttcgttcc

SEQ ID NO: 354179 - DNA, 512 bp, Homo sapiens
  misc_feature: GZ8MTXP01D7WG2.13.8.A08.1.454.CMB.2.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
  modified_base (493)..(493): a, c, t, g, unknown or other
  misc_feature (493)..(493): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccggnaagtcagaccattgaacaaatatgtaaattggtatcaacagaagccaggtgaacgcccctaagctcctgatctatactgcatcctatttgcaggcgggtccagtccaaggttcgtggcagtggatgtgggacagtattcactctcacatcacagtctgacaactgaagactgtacactaaacttactactacgaccaaacgtacgttaccttaaccggaccttacggtactacgtttcggaccgagggaaccaggctaggagataacaaacgacttgnggctcgcacatcttgttcc

SEQ ID NO: 354180 - DNA, 542 bp, Homo sapiens
  misc_feature: GZ8MTXP01B5LL3.13.8.A08.1.454.CMB.2.raw
  modified_base (350)..(350): a, c, t, g, unknown or other
  misc_feature (350)..(350): n is a, c, g, or t
  modified_base (480)..(480): a, c, t, g, unknown or other
  misc_feature (480)..(480): n is a, c, g, or t
tcagtcacgtactacacgaccggtgctcgatttagcatactctacaggggggagtcagtctcagtcaggacacagcatggacatgagggtcccgctcagctcctggggctcctgctactctggctccgaggtgccagatgtgacatccagatgacccagtctccatcctccctgtctgcatctgtaggagacagagtccaccgtcacttggccgggacaagtcagaccattgaactaaatatagtaaattggtatcaacagaagccaaggtgaacgcccctaagctcctgatctatactgcatcccatttgtcaggcgggtccatccgaaggttcgtgcagtgggatcgngggacagtatttcactcacaccatcacagtctgacaacctgaacgactggctactaaaccttacgtactcgaccaacgtagtccgttaccggaaccttcggtactacgttttcggaccggaggggaaccngggttccgtaggaggtaaactacgaaacgccttaggtggcttcgacacttatcgttgtttcc

SEQ ID NO: 354181 - DNA, 535 bp, Homo sapiens
  misc_feature: GZ8MTXP01DR3BW.13.8.A08.1.454.CMB.2.raw
  modified_base (405)..(405): a, c, t, g, unknown or other
  misc_feature (405)..(405): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaaagtcagaccattgaacaaatatagtaaattggtaatcaaacagaagccaaggtgaaacgcccctaagctcctgatctatactgcatccactttgtcaggcgggtcccatccgaaggttcgtggcagtggatcgtagggacagtatttcactctaccacatcaccagtctgacaacctgaagactgtnactaacttactactgaccaaacagttaccgtaacggtaacctacggttactacgttttacggaccgaggggaacccaaggcgtaggaagactaacaaaacgacttgtaaggctgcaccatcttgttaacc

SEQ ID NO: 354182 - DNA, 532 bp, Homo sapiens
  misc_feature: GZ8MTXP01AUKKD.13.8.A08.1.454.CMB.2.raw
  modified_base (215)..(215): a, c, t, g, unknown or other
  misc_feature (215)..(215): n is a, c, g, or t
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (349)..(349): a, c, t, g, unknown or other
  misc_feature (349)..(349): n is a, c, g, or t
  modified_base (488)..(488): a, c, t, g, unknown or other
  misc_feature (488)..(488): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacgtcacttgccgggnaagtcagaccattgaacaaatatgtaaattggtatcaaacagaagccaggtagaacgcccctaagctcctgatctatactgactatcctactttgcagggccggggtcccatccaaggttcgngcngtgatcgngggacagtatttcactctacaccatcaccagtctagaccaacctgaaagcctagtgacctaaacttactactacgaccaaactacgttacctacggtaacctacgtactaccgttttcggccgtacggggaacacgggntacggagaactacgaaacgacttgtgctgccacagtcttgttcc

SEQ ID NO: 354183 - DNA, 527 bp, Homo sapiens
  misc_feature: GZ8MTXP01EVGUO.13.8.A08.1.454.CMB.2.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (507)..(507): a, c, t, g, unknown or other
  misc_feature (507)..(507): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtnacttgccgggnaagtcagaccattgaacaaatatgtaaattggtatcaacagaagccaggtgaaagcccctaagctcctgatctatactgcatcccactttgtcacggcggggtcccatccaagggttccgtggcagtcggatctggggacagtatttcactctacaccatcacctacgtctgacaaccttgaacgactcgtagactaaactttacgaacttcgaccaaacagtcttaaccggactacctactacgttttcggccgaggggaaccagggctggacgatacaaaacgcttagnggctgcacgatcgttgttcc

SEQ ID NO: 354184 - DNA, 668 bp, Homo sapiens
  misc_feature: GZ8MTXP01CHXNF.13.8.A08.1.454.CMB.2.raw
  modified_base (215)..(215): a, c, t, g, unknown or other
  misc_feature (215)..(215): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccggnaagtcagaccattgaactaaatatagtaaattggtatacaaacagaagccgaaggtacgaaacgccccctaaagtcctaccgtgtaactactaataccttgacctacttaccctaacgttttcggaccgacgggggtcccggggtacccctagttaccccgtaaacggggtttccggtagggaccgtaagggtgggtaacgttccggtagggggaactaaacgggttacttttaccaccttacctacccaaccctaacgttaccaacccgtaggttccttacgaacctaaccgtagaacgtactgtacactaacttacgtactcgaaccaagtacgttacctaacggtaaccttacgtacttacgtttacggaccgtaacgggaaccgaggttcgtaggaagtacgtaacgaaacgttattcggtggactgacctacttactcgttaagttcc

SEQ ID NO: 354185 - DNA, 567 bp, Homo sapiens
  misc_feature: GZ8MTXP01BI07O.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttggccgggacaagtcagaccattgaacaaatatagtaaattggtatcaacagaagcaggtgaacgcccctaagctctgatctatactgcatccctactttgcacgggcgggtccagtccgtaaggttcgtggctaggtgatcgtgggacagtactttcactctacaccatccacagtctgaccaacgtagaacgtactgtagactaacttacgtactacgtaccaactacgtaccttaaccggtaaccttaccgttacgttacgttttacggacccgtaaggggaaccgacgggcgtaggacgaacgtaacgaaacggacgttcggtaacgcgtcgaccaccttactcgttcgttaacc

SEQ ID NO: 354186 - DNA, 646 bp, Homo sapiens
  misc_feature: GZ8MTXP01D9804.13.8.A08.1.454.CMB.2.raw
  modified_base (221)..(221): a, c, t, g, unknown or other
  misc_feature (221)..(221): n is a, c, g, or t
  modified_base (576)..(576): a, c, t, g, unknown or other
  misc_feature (576)..(576): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtccaccgtcacgttggcccggganaagtcaagaccattagaactaaatatagtaaattggtatacaacagaacgccgaaggtacgaaacgcccctaaagcctcctagactctaactactgacctactcccttacgttttcggaccgacgggtccggggtaccccagttaccgtaacgggttcggtggactaggtagggatcggtagggaccagttactttccacttctacacccactaccaccgtagttcgtagacctaaacgtacgaaacgtaccgtagtacgtaactaaacctttactaacgttacgaaccctaaacgtacgtaccttaaccggtaaccttaccgtacgttaccgtttcggaccgaacggggtaacngggacgtaggacgtaactaccggaaaacgttcgttaggcggtactcgaccacttacgttccttcgttccc

SEQ ID NO: 354187 - DNA, 515 bp, Homo sapiens
  misc_feature: GZ8MTXP01CJJ8B.13.8.A08.1.454.CMB.2.raw
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
  modified_base (510)..(510): a, c, t, g, unknown or other
  misc_feature (510)..(510): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaaacagaagccaggtgaaagccccctaaagctcctagatctatactgcatccactttgtcaggcggggtcccatccaaggttcgnggcagtggatcngggacagatttcactctcacatcacagtctgacaacctgaacgactgtagctaaactttactactgaccaaacgagtccttaacggaaccttacgtactaacttttggacctgggggaaccagggctgggagtactgaaaccgattgtaaggctgcaccatcngttcc

SEQ ID NO: 354188 - DNA, 648 bp, Homo sapiens
  misc_feature: GZ8MTXP01EI16K.13.8.A08.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggnaagtcagaccattgaactaaatatagtaaattggtaatacaaacagaagccaagggtagaaacgtaccccctaaagcctacctgacttactataactgctaacttccctaacgttttggtaccgaacgggggtcccggggtaccccaagttccccgtaaacgggtttccgtgggaccgtagggtagggaacttcggtaggggtaaccaagggttaacttttccgaaccttcttaacccaaccctaacttaccgaaccacgttaccttacgacctaaacccgttagaaacggtaactgtacgaactaaaccttaacgtactacgaccaaactacgttactaacggtaacctactacgtacgtttcggccgtagggaaccgaggacgtgaagactaacgaaacgcgttagtggactcgacaccatcgttgttcc

SEQ ID NO: 354189 - DNA, 747 bp, Homo sapiens
  misc_feature: GZ8MTXP01D67P7.13.8.A08.1.454.CMB.2.raw
  modified_base (223)..(223): a, c, t, g, unknown or other
  misc_feature (223)..(223): n is a, c, g, or t
  modified_base (670)..(670): a, c, t, g, unknown or other
  misc_feature (670)..(670): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatcgacccagtctccactcctcctgtctgcatctggtaggagacagagtccaccgtcacgttcggccggganaagtcaacgacctattagaactaaatatagtaaattggtatacaacgagaacgccgaaggtacgaaacgtaccccctaagtcctaccgtagtacttactaataactgactacttcccttaacgttttggccgtaacggggtcccgggggtaccctaagttaccccggtaaacggggtttccggtgggaccgtaggggtacgggtaacttcggggtacgggtaaaccgtagggttaacttttacccgaaccttccttacccaaacccttaacggttacccaaccctaaggttccttacggaaccctaaaccgtagaaacggtactagggtacctaaacctaaccgtttaacgtaaccttacgaaccctaaacgtaccggttaaccgttaacccgggtaacctttacccgtacgttaccggtttaccgggaccgggtaggggtaacccngggccgttaacggggaataacgtaacggaaacgttacgttcggcggtcaacggtctaccttagttccgttgtttccc

SEQ ID NO: 354190 - DNA, 522 bp, Homo sapiens
  misc_feature: GZ8MTXP01EG913.13.8.A08.1.454.CMB.2.raw
  modified_base (216)..(216): a, c, t, g, unknown or other
  misc_feature (216)..(216): n is a, c, g, or t
  modified_base (404)..(404): a, c, t, g, unknown or other
  misc_feature (404)..(404): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgacaaatatagtaaattggtatcaacagaagccaaggtgaaacgcccctaagctacctgatctaatactgcatcccacttttgcagggcggggtcccagtccgaaggttcgtggcagtaggatcgtgggacagtattcactctcacatcacagtctgacaacctgaagactgtanactaacttacgtactgaccaatacgtaccttacggacctacgttactacgtttcggaccgtaggggaacaggcgtaggagataacaaacgacgttgtggactcgcaccatcttgttcc

SEQ ID NO: 354191 - DNA, 576 bp, Homo sapiens
  misc_feature: GZ8MTXP01D3FZR.13.8.A08.1.454.CMB.2.raw
  modified_base (219)..(219): a, c, t, g, unknown or other
  misc_feature (219)..(219): n is a, c, g, or t
  modified_base (354)..(354): a, c, t, g, unknown or other
  misc_feature (354)..(354): n is a, c, g, or t
  modified_base (367)..(367): a, c, t, g, unknown or other
  misc_feature (367)..(367): n is a, c, g, or t
  modified_base (390)..(390): a, c, t, g, unknown or other
  misc_feature (390)..(390): n is a, c, g, or t
  modified_base (394)..(394): a, c, t, g, unknown or other
  misc_feature (394)..(394): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctggtaggagacagatcaccgtcacgttggccggganaagtcacgaccattagaacaaatatagtaaattggtatacaacagaacgccgaggtacgaacgcccctaagctcctagtactctatactgctatcctagtttgcgaggtccggggtaccagtccgaacggttcgnggcaggtgatcgngggacagtacttcactctcacancacngtctgactacctagacgactgacgtactaacttactacgtcaaccaacgtagtccgtaacgtacctacgtacgtacgtttcggaccgtacggggaaccagggttactaggaaggaacttaaccgaaacggttaccgttgggtaacggtactcgtaccaccgttacttccgttcgtttaaccc

SEQ ID NO: 354192 - DNA, 657 bp, Homo sapiens
  misc_feature: GZ8MTXP01CXLS3.13.8.A08.1.454.CMB.2.raw
  modified_base (219)..(219): a, c, t, g, unknown or other
  misc_feature (219)..(219): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccgtcacttggccggganaagtcagaccattgaacaaatatagtaaattggtatacaacagaacgccaggtagaacgcccctaagcctcctgatctatactgactacttccctacgtttcggtacgacgggggtccggggtccctaagttccccgtaaacggggtttccgtggggtacctaggtaacgggtatccggtaggggacctaggttactttccacttcctacaccctagtaccacagtcttacgacctaaccgtagaacgacgtgtacgtaccttaaccttacgtaccgtcgtacccctaaacgtacgttaccgttaccggtaaccttcggtaaccttacggtttcggaccgacggggaaccagggttcgtacgggaactaacgtaaccgaaaacggttcgttacggttcgggccttcggaccctaccgttactttccgttaagtttccc

SEQ ID NO: 354193 - DNA, 513 bp, Homo sapiens
  misc_feature: GZ8MTXP01E08R3.13.8.A08.1.454.CMB.2.raw
  modified_base (215)..(215): a, c, t, g, unknown or other
  misc_feature (215)..(215): n is a, c, g, or t
  modified_base (399)..(399): a, c, t, g, unknown or other
  misc_feature (399)..(399): n is a, c, g, or t
  modified_base (492)..(492): a, c, t, g, unknown or other
  misc_feature (492)..(492): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgaacaaatatgtaaattggtatcaacagaagccaaggtgaaagccccctaagctcctgatctatactgcatcccacttttgtcaggcggggtcccatccaaggttcgtggcagtggatcgtgggacagtatttcactctcaccatcacagtctgacaactgaagactgtcncaaacttcactcgacctaacagttctaaccggtaacctcgtactactttggccgtaggggaaccaggctgggttacgagtacaaacgacttgngctgccaccatccgttgttcc

SEQ ID NO: 354194 - DNA, 621 bp, Homo sapiens
  misc_feature: GZ8MTXP01C558W.13.8.A08.1.454.CMB.2.raw
  modified_base (216)..(216): a, c, t, g, unknown or other
  misc_feature (216)..(216): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattagaacaaatatagtaaattggtatacaacagaagccaaggtacgaacgacccctaagcctcctagatctatactgacattcctacgtttgtacgacgggtccggggtccagtcccgtaacggtttccggtggcctaggtacggatcggtacgggactaggtaactttccactctaccaacctactaccacctagtcctacgaccaaaccgttacgaacgtacgtcgtactacctaaaccttacgacttaccgaccaaacgtacgttaccttacccggtaaccttaccgttaccgtacgtttccggaccggacgggtaacccagggacgtaggagtactaacgaaacgagttcggtaacggcttcgacctaccgttattccgttaagtttccc

SEQ ID NO: 354195 - DNA, 599 bp, Homo sapiens
  misc_feature: GZ8MTXP01BID2A.13.8.A08.1.454.CMB.2.raw
  modified_base (217)..(217): a, c, t, g, unknown or other
  misc_feature (217)..(217): n is a, c, g, or t
  modified_base (345)..(345): a, c, t, g, unknown or other
  misc_feature (345)..(345): n is a, c, g, or t
  modified_base (387)..(387): a, c, t, g, unknown or other
  misc_feature (387)..(387): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctatctgcatctgtaggagacagagtcaccgtcacttgccggganaagtcagaccattgaacaaatatagtaaattggtatacaacagaagccgaggtagaacgccccctaagcctcctgatctatactgactatccctatttgcgacgggcggtccagtccgaacggttcgnggcaggtggatcgtgggacagtcttcactctacactatcacngtctgacactagacgactgacacttaacttacgtaactcgaccctaacgtacgttacccgttaaccggtaaccttaccggttaacttaccggtttcgggacccggtaacgggggaaccctaagggccgttagggaacgtaacgtaaccgaaaccggttacgttcgggtaacgtccgtaacggtacctaccttacgttccgttaacgtttccc

SEQ ID NO: 354196 - DNA, 529 bp, Homo sapiens
  misc_feature: GZ8MTXP01CNFW1.13.8.A08.1.454.CMB.2.raw
  modified_base (215)..(215): a, c, t, g, unknown or other
  misc_feature (215)..(215): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgacaaatatgtaaattggtatcaacagaagccaggtagaagcccctaagctcctgatctatactgcatccactttgtcaggcgggtccatccaagggttccgtggcagtaggatcgtgggacagtatttcactctcaccatccaccagtctgacaacctgaacgactgtgctaacttactactacgaccaacgacgtacttaccggaaccttcgtactcttttggcccgtaggggaaccaggcgtaggagtacgtacaaaacgcttggtaaggcttggccaccttattcgttcgtttaacc

SEQ ID NO: 354197 - DNA, 508 bp, Homo sapiens
  misc_feature: GZ8MTXP01AO63O.13.8.A08.1.454.CMB.2.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (284)..(284): a, c, t, g, unknown or other
  misc_feature (284)..(284): n is a, c, g, or t
  modified_base (492)..(492): a, c, t, g, unknown or other
  misc_feature (492)..(492): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtnacttgccgggcaagtcagaccattgaacaaatatgtaaattggtatcaacagaagccaggtgaacgcccctaagctccngatctatactgcatccactttgtcaggcgggtccatccaaggttcgtggcagtggatcgtgggacagatttcactctcacatcacagtctgacaacctgaagactgtacactaacttacgtactgaccaactacgtcttaacggaccttacgtactacgtttcggccgaggggaaccaggcgtggagactacgaaacgacttgtggcncgcacactcgttcgtc

SEQ ID NO: 354198 - DNA, 579 bp, Homo sapiens
  misc_feature: GZ8MTXP01B9J6Q.13.8.A08.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (338)..(338): a, c, t, g, unknown or other
  misc_feature (338)..(338): n is a, c, g, or t
  modified_base (350)..(350): a, c, t, g, unknown or other
  misc_feature (350)..(350): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggnaagtcagaccattgaacaaatatagtaaattggtatacaacagaagccaggtgaacgcccctaagctcctgatctatactgctatcctactttgtcaggccgggtcccagtccgaaggttcgngcagtggatcgngggacagtatttcactctaaccatcacagtctgacaacctgaagtactgtacgactaaacttactacttacgaccctaaactacgttaccttaaccggaaccttacggttaacctaccgttttacgggaccgtaacggggtaccaagggtcgttagggaacgactaaccgaaacgttaacgttggttcgggtaactacggcctacctattccttaacgttctttaaccg

SEQ ID NO: 354199 - DNA, 574 bp, Homo sapiens
  misc_feature: GZ8MTXP01ES3EW.13.8.A08.1.454.CMB.2.raw
  modified_base (216)..(216): a, c, t, g, unknown or other
  misc_feature (216)..(216): n is a, c, g, or t
  modified_base (348)..(348): a, c, t, g, unknown or other
  misc_feature (348)..(348): n is a, c, g, or t
  modified_base (362)..(362): a, c, t, g, unknown or other
  misc_feature (362)..(362): n is a, c, g, or t
  modified_base (408)..(408): a, c, t, g, unknown or other
  misc_feature (408)..(408): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccgtcacttgccggnaagtcagaccattgaacaaatatagtaaattggtaatacaaacagaagccaaggtacgaaacgcccctaagcctcctgatctatactgctatccctatttgcgagggcggggtcccagtccgaagggttcgnggcaggtggatcgngggacagtatttcactctcacatcacagtctgacaactgaagctgnacctaactttacactcgacctaaacgtacgttaccgttaaccggaacccttacgtaaccgttacgtttacgggaccgtaacgggggaaccaagggttccgtagggaagtaactaacgaaaacgttcgttacggtggcctcgacctacacgttcgttaacgtttccc

SEQ ID NO: 354200 - DNA, 642 bp, Homo sapiens
  misc_feature: GZ8MTXP01DA1PO.13.8.A08.1.454.CMB.2.raw
  modified_base (363)..(363): a, c, t, g, unknown or other
  misc_feature (363)..(363): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacgttggccgggacaagtcaagaccattagaacaaatatagtaaattggtatacaacagaacgccgaaggtacgaaacgccccctaagcctacctagactactatactgctatcctacgtttgcgacgggtccgggtcctagtaccgaacggttccgnggcaggtaggacttcggtagggactagtacttcactctacactactccacacgtctcgacaaccgtagaacgtacgtgtactacttaaaccttacgtaactacgtaacctaacgtacgttaccgttaaaccggtaacccgttaccgttaaccgttaccggttttacgggacccggaacggggtaaccgtagggttaccgtagggaacgtaacgtaaccgaaaacggttacgttacggtaacgggtactcggacctaccgttacttcgttcgtttaaccc

SEQ ID NO: 354201 - DNA, 618 bp, Homo sapiens
  misc_feature: GZ8MTXP01EFZV0.13.8.A08.1.454.CMB.2.raw
  modified_base (216)..(216): a, c, t, g, unknown or other
  misc_feature (216)..(216): n is a, c, g, or t
  modified_base (400)..(400): a, c, t, g, unknown or other
  misc_feature (400)..(400): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattagaacaaatatagtaaattggtatcaacagaagccgaggtgaacgcccctaagctcctagatctatactgactactccctactttggtacacggcgacggtccccaagtccgtaaggttcccgtggctaaggttgaatcgtagggactagtactttcacttctacacctancactagtctacgactaaccgtagaacgtacgtgtacgaacctaacgtttactacgttacgacctaaacgtacgttaccgttaacggaaccttcgtaaccttacgtttcgggaccggtaacggggaccgagggtaccgttaggaacgtaacgttacgttaaaaccggttacgttaacggtcgggtaaccttcggacccttaccgtcttaaccgtttccg

SEQ ID NO: 354202 - DNA, 581 bp, Homo sapiens
  misc_feature: GZ8MTXP01DYFOP.13.8.A08.1.454.CMB.2.raw
  modified_base (339)..(339): a, c, t, g, unknown or other
  misc_feature (339)..(339): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgaacaaatatagtaaattggtatacaaacagaagccaggtagaaacgccccctaaagcctcctgatctatactgcatcctactttgcaggcgggtccatccgaggttcgnggcagtggatcgtggacagtattcactctacacatcacagtctgacaactagaagactggtacactaaacctttacgtactacggtacccaaactacgttaccgttaaccggaaccttaccggttaactaccggttttacggacccgtacgggggaacccaggggttacctaggggaactaacgtacaaaacggttacgttacggtcgggtactcggactacccttattccttgtttaaccc

SEQ ID NO: 354203 - DNA, 648 bp, Homo sapiens
  misc_feature: GZ8MTXP01AN0LS.13.8.A08.1.454.CMB.2.raw
  modified_base (204)..(204): a, c, t, g, unknown or other
  misc_feature (204)..(204): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatcgacccagtctccatcctcctgtctgcatctgtaggagacagagtcaccgtnacttgccgggtacaagtcagacctattgaacaaatatagtaaattggtatcaacagaagccaggtagaacgcccctaagctacctgactctatactgacatcctatttgcacggcggggtacccagtacccgtaaggttcgtaggcctaggtagggactcgtggggacctaggtactttcactctaccacctatcaacctagtctaggaccaacccttagaacgtacctaggtacaccttaaaccttacctaaccgttaccggacctaaaccgtacggttacccttaaccggggtaaccccttacgttaccgtaaccgttttcgggaaccccgttaggggggaaccccaggggttacccgttgggaaagtaccgttaacaaaaccgggttaaccttgggttaaccggcttaacggacccaccggttacttccgttcggtttccc

SEQ ID NO: 354204 - DNA, 615 bp, Homo sapiens
  misc_feature: GZ8MTXP01CJ6TI.13.8.A08.1.454.CMB.2.raw
  modified_base (220)..(220): a, c, t, g, unknown or other
  misc_feature (220)..(220): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccgtcacgttggccggganaagtcagaccattgaacaaatatagtaaattggtatacaacgagaagccgaggtagaacgacccctaagcctcctgacttctatactgctactccctacgtttgtcgagggccgggtaccagtcccgtaagggttcgtggctaggtaggactcgagggtacagtacttcactctaccaccatccgactagtactacgacctaaaccgtagaacgtacgttgtacgaccttaaacttacctaacgtacgacccaaacgtacggttaacccgttaaccggtaacccttccgttaacttccggttttacggacccggtacgggggaacccaggttcgtaggaacgaacgttacaaacggcgttaggtcggctaagaccctacgacttcgttcgtttcc

SEQ ID NO: 354205 - DNA, 765 bp, Homo sapiens
  misc_feature: GZ8MTXP01BZ4US.13.8.A08.1.454.CMB.2.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (218)..(218): a, c, t, g, unknown or other
  misc_feature (218)..(218): n is a, c, g, or t
  modified_base (262)..(262): a, c, t, g, unknown or other
  misc_feature (262)..(262): n is a, c, g, or t
  modified_base (281)..(281): a, c, t, g, unknown or other
  misc_feature (281)..(281): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtnacgttggccgganaagtcacgaccattagaactaaatatagtaaattggtatacaanagaagccgaggtacgaacncccctaagcctacctagactactatactgactactccgttactttggaccgacgggtccggggtacccagttaccccggtaacgggttttccggaggtccgtaagggttacgggtaacttccggggtaggggtaaacctaggttactttttacccaaccttcccttaacccaaccctaacttacccgaacccgtacggttacctaacgtaacccgtaaacccgttaaggaaacgggtaccttacgggttaaccgtaaacttaaacccgtttaacggttaacccttaaccggtaaacccctaaaccgttaaccggtttacccgtttaaacccggggtaaccctttacccggttaaaccgtttaccgggttttaccggaaccgggtaccggggtaaccgtacgggttacgttagggaacgtaaccgtaacgttaaacggttacgttaggtggtacctcgacctacgttacttccgttcgtttaacc

SEQ ID NO: 354206 - DNA, 570 bp, Homo sapiens
  misc_feature: GZ8MTXP01AMHA6.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccgtcacttgccgggcaagtcagaccattgaacaaatatgtaaattggtatcaacagaagccaggtgaacgcccctaagctcctgatctatactgcatcctactttgtcgaggcggggtccagtccgaaggtccgtggcagtggatcgtgggactagtacttcactctcacctatccacagtctacgacaacctagaacacgttgtagacctaacttactactgacccaaacgtacgttcgttaaaccggacccttacggtaccttacgtttcggaccgtacgggggaaccagggttctagggacgtaacgtaacgaaacggacgttggtaacgggctcggaccctaacttacgttccgttcgtttccc

SEQ ID NO: 354207 - DNA, 611 bp, Homo sapiens
  misc_feature: GZ8MTXP01CDYEB.13.8.A08.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggnaagtcagaccattgaacaaatatagtaaattggtatacaacagaagccaggtgaacgcccctaagctcctgatctatactgctactcctatttgcgagggcggggtcccagtacccgaacggttcgtggcaggtggatcgtgggaccagtatttccacttctcaccctatccacctagtcttacgaccaaccctagaacgtactgtacgtactaaacctttaacgtacgtacgacccaaacgtacgttacccgttaaccggaacccttcgttaacgtaccgttttcgggacccggtagggggaacctacgggttcgtacgggttagtaacgtaacgttaaaacggttcttcgggttaaggcgttcggactaccgttactccgttcggtttaaccc

SEQ ID NO: 354208 - DNA, 723 bp, Homo sapiens
  misc_feature: GZ8MTXP01EQUWZ.13.8.A08.1.454.CMB.2.raw
  modified_base (218)..(218): a, c, t, g, unknown or other
  misc_feature (218)..(218): n is a, c, g, or t
  modified_base (272)..(272): a, c, t, g, unknown or other
  misc_feature (272)..(272): n is a, c, g, or t
  modified_base (325)..(325): a, c, t, g, unknown or other
  misc_feature (325)..(325): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttggccggganaagtcagaccattgaacaaatatgtaaatggtatacaacagaagaccgagcacncctactctactactatactatactacgtactacttactacgttcggtacggtnaccccggtacgggtaccgtaacgttacgtaacgggtaaccggtacgggtcgtaggtacgggtacggtacgtacgggtaacgttacgtaactttacctacctacctactacctaactacgtaccgtacgtacgtacgtacgtaaaccgtaacgtaacgtaacgttacggttaacgttaacctaaaccttaaccgtaaccgtaaccgtaacccgtaaaccgttaaaccggttaaccgttaaccggttaacccgttaaccgtttaaccggttaacccggtttaacggggttaacccgggtaaccggggttaaccggtaacgggtaacggttaacggttaacgttaaacgtaaacgtaaacggtaacggtacggtacggttacgtaacgttaaccgtaaccg

SEQ ID NO: 354209 - DNA, 568 bp, Homo sapiens
  misc_feature: GZ8MTXP01BNO5F.13.8.A08.1.454.CMB.2.raw
  modified_base (215)..(215): a, c, t, g, unknown or other
  misc_feature (215)..(215): n is a, c, g, or t
  modified_base (254)..(254): a, c, t, g, unknown or other
  misc_feature (254)..(254): n is a, c, g, or t
  modified_base (390)..(390): a, c, t, g, unknown or other
  misc_feature (390)..(390): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcacgtcacttgccgggnaagtcagaccattgaacaaatatgtaaattggtatcaanagaagaccaggtgaacgcccctaagctcctgatctatactgcatccctatttcgcacgggcggggtcccagtccgaaggtttccgtggcaggtagggactcgtgggaccaggtactttcactctacaccatccacngtctagacctaaccgtgaaacgtctcgtgaacctaacctttactaactcggtacccaaatacggttaccttaccggaaccttcgttactacgttttcggacccgtaaggggaaccctgggcgtagggagtaacgtacgaaacgttacttggtggctcgctaccagttcttaacgttcc

SEQ ID NO: 354210 - DNA, 616 bp, Homo sapiens
  misc_feature: GZ8MTXP01BJ2EV.13.8.A08.1.454.CMB.2.raw
  modified_base (221)..(221): a, c, t, g, unknown or other
  misc_feature (221)..(221): n is a, c, g, or t
  modified_base (419)..(419): a, c, t, g, unknown or other
  misc_feature (419)..(419): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatcgacccagtctccatcctccctgtctgcatctggtaggagacagagtcaccgtcacttggccggganaagtcagaccattgaacaaatatagtaaattggtatacaaacagaagccgaaggtacgaaacgacccctaagcctcctagactctatactgctatcctatttggcgacgggcggggtcccagtccgtaacgggttcgtggcgaggtaggactcgtggggaactagtacttacactctaccactactaccactagtccngaccaaccgtaggaactcgttagtacacttaaacgttactacgttacgacctaaacgttacgtacccgtttaaccggtaaccttaccggttaacttaccggtttacgggacccggacgggggaaccctagggttcgtaggacgtaacgtaacaaaacggttcgttaggtcggctcgacctacttagtcttcgttccc

SEQ ID NO: 354211 - DNA, 631 bp, Homo sapiens
  misc_feature: GZ8MTXP01APA2H.13.8.A08.1.454.CMB.2.raw
  modified_base (217)..(217): a, c, t, g, unknown or other
  misc_feature (217)..(217): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggcgccagatgtgacatccagatgacccagtctccatcctccctgtctgcatctgtaggagacagagtcaccgtcacttggccgggnaagtcagaccattgaacaaatatagtaaattggtatacaacagaacgccaggtagaacgcccctaagcctcctagatctagtactgctactcctactttgacgacgggtccgggtaccagtccgtaacggttcgtggcgtaggtggatcgtagggacctaggtactttcactctaccacatccacacgtctacgacaactgaacgactgtacgactaaccttacgttactacgaccctaacgtacgttaccgttaaccgtaaccgtttaccggtaccttaccggttttacgggacccggtacgggggtaacccgagggttaccggttacgggaacgggtaactaaccggttaaaaccggttacgttacgggtcgggtacgtcggtacccaccgttacttccgttcggtttcccg

SEQ ID NO: 354212 - DNA, 719 bp, Homo sapiens
  misc_feature: GZ8MTXP01B1GMP.13.8.A08.1.454.CMB.2.raw
  modified_base (217)..(217): a, c, t, g, unknown or other
  misc_feature (217)..(217): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaccgtcacttgccgggnaagtcagaccattgaactaaatatagtaaattggtatacaacagaagccaaggtgaaacgcccctaagcctcctagactctatactgactactccctacttttcggcgaacgggccgggggttaccccagttcccgtaaacggggtttccggtgggaccgtaggtagggacttccggtagggggaacctaggtacttttccaacttcctaccaaccctactaccaaccctacggttaccttaggaaccctaaacccgttaggaaacgtaccgttagtacggaccttaaacctttaacctaaccgttacggaaccctaaaccgtaaccggttacccgttaaacccgggtaaccctttaccgttaaccgttaacccgtttttacgggacccggtaacgggggaacccgtacgggaccgttagggaacgtaacgtaaccgaaaaccggttaaaccgttgggtaacggtccgtcggacctaccttacttaaccgttcgtttaaccc

SEQ ID NO: 354213 - DNA, 690 bp, Homo sapiens
  misc_feature: GZ8MTXP01CLXDS.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgaactaaatatagtaaattggtatacaaacagaagccaggtagaaacgcccctaagcctcctgatctatactgactactcctacgtttcgtacgacgggtccggggtacccaagttaccccgtaaacggggtttccgtagggaccgtagggttacgggtaacgttcggtacgggggtaaactaacgggttactttaccgacctttcctaccctaaccctactacccgaacctacggttcctacggaacctaaccgttagaaacgtacttcggtactacctaaacctttacgtacgttacgaaccctaaacgtacggtttaaccgttaacccggtaaccttaccgtaccgttacgtttccgggaccggaacgggggtaacccaagggcgtaggaacgtaacgtaacgaaaaccgttgttcggtaacggctaacggacctaccgttattccgttaagtttccc

SEQ ID NO: 354214 - DNA, 671 bp, Homo sapiens
  misc_feature: GZ8MTXP01CPIH1.13.8.A08.1.454.CMB.2.raw
  modified_base (382)..(382): a, c, t, g, unknown or other
  misc_feature (382)..(382): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtcctccactcctccctgtctgcatctggtaggagacagagtccaccgtcacgttcggccgggacaagtcagaccattagaacaaatatagtaaattggtatacaaacagaacgaccgaggtacgaaccgcccctaagcctcctagtacttactatactgactactcccttacgtttcggtcgacgggtccggggtaccctagtacccgtaacgggttccgnggtactaggtggatcggtagggaactaggttactttaccgacttcaccacctataccaccgtagtcctacgacctaaccgtagaacgtacttacgtactaccttaaacctttactaaccgtacggaaccctaaacgtacgtttacccgttaacccggtaaccttaccggttaacgttaccggtttacgggaacccggtacggggaacctagggttcggtacggaacgtaacgtaacgaaacggttcttcgggtaacgctaacgacctacgttacttccgttcgtttccc

SEQ ID NO: 354215 - DNA, 700 bp, Homo sapiens
  misc_feature: GZ8MTXP01DYSOA.13.8.A08.1.454.CMB.2.raw
  modified_base (219)..(219): a, c, t, g, unknown or other
  misc_feature (219)..(219): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtccacgtctacttcggccggganaagtcagacctattgaacaaatatagtaaagttgtatacaacaagacgcgaaggtagaacgacccctaagctcctagactactatactgactactccctactttcgtacgacgggccggggtacccacgtaccgtaacggtttcggtggcgtaggtaaggatcggtaggacgtaggttacttcgactctaccacctataccggaacctagttaccgacggtaaccaaaccgttacgaaacggtacccgttagtaaccgtaccttaaacccgtttaacttaccgtaacgtaacccttaaaccgtaacgtttaacccgttaacccgggtaaacctttaccgttaaccgtttccggttttacccgggaccggttaaaccggggaaccgtacgggaccgttaggggaaacttaagaaccgttaaaacggttgttacggtgggtacccttaaggaccctaacgttactttcgttaaccgttttccg

SEQ ID NO: 354216 - DNA, 656 bp, Homo sapiens
  misc_feature: GZ8MTXP01DBD3N.13.8.A08.1.454.CMB.2.raw
  modified_base (191)..(191): a, c, t, g, unknown or other
  misc_feature (191)..(191): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtccaccgtcacttggccgggcaaagtcagaccattagaactaaatatagtaaattggtatacaacagaagccgaggtagaacgcccctaagcctcctgatctaatactgctatccctactttgtacgacgggccggggtccagtccgtaacgggttccgtggacaggtagggactcggtagggactagtactttccacttctaccacctactaccaaccgtacgttctacgacctaaaccgtacgaaacgtacgttagtacgtaaccttaaaccttacttacctacgaaccctaaacgtacgttaccgttaaccggtaaccgttaccgttaccgttacgttttacgggaccggtacgggggtaaccgtacgggaccggttagggaacgtaaacgtaaccgaaaacggttacgttacgggtgaccgttcgaccgtaccttacttccgttaacgtttcccg

SEQ ID NO: 354217 - DNA, 574 bp, Homo sapiens
  misc_feature: GZ8MTXP01ARG3M.13.8.A08.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (333)..(333): a, c, t, g, unknown or other
  misc_feature (333)..(333): n is a, c, g, or t
  modified_base (352)..(352): a, c, t, g, unknown or other
  misc_feature (352)..(352): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggnaagtcagaccattgaacaaatatagtaaattggtatcaaacagaacgccaggtagaacgcccctaagctcctgatctatactgcatccatttgcagggcggtccatccgaggttcgnggcaggtgatcgtgggacngtatttcactctacaccatcacctagtctgaccaaccgtagaacgtacgtgtacgtacctaaaccttacgtaactcgtacccaaacgtaacgtaccgttaaccgggtaaccttacgtaactaccgttttacggcccggtaacggggaaccaacgggcgtacgggacgaactaacgaaaacgacgttggtaacgggctaacggccctacttactcttcgttcc

SEQ ID NO: 354218 - DNA, 610 bp, Homo sapiens
  misc_feature: GZ8MTXP01B2S4G.13.8.A08.1.454.CMB.2.raw
  modified_base (354)..(354): a, c, t, g, unknown or other
  misc_feature (354)..(354): n is a, c, g, or t
  modified_base (374)..(374): a, c, t, g, unknown or other
  misc_feature (374)..(374): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcgtctctcggagacagggtcaccatcacttgtcgggcaagtcagaacattggctaacttctttaaattggtatcagcagaagtcagggcaacgcccccgaacctcctgactctacggtacatccacttttgcacaggtcgggactcccatcaaggttcaggtggcagtagaatcnggaactagtacttttacccncaccatcgagggtctacgacgctagagtatttgacgtactttactattgtacaacgtaggtaacgtttacccgttcccgtacccccggtacgttaccggaccgtaacgggaacccgtaaaggggtacgaaacgttacgaaacggaaccggtaaacgttggtacggccgttacgcccgaccttacttccgttcgttacctttcctacttcccgtttccccgtcccttaacgtttccg

SEQ ID NO: 354219 - DNA, 693 bp, Homo sapiens
  misc_feature: GZ8MTXP01BO456.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgagccagtctccatcccaccctgtctgcgtctcgtcggagacagggtcaccatcacgttgcgggacaagtcaagaactattggactaaacttctttaaagttggtatcagcagaagtcgaaggcaacgccccgaactcctgactctacggtacactcctactttcgacacgtaggtcggtaactcccgtatacgtaacggttcaggtcggactaagtaagtacttcggtacgggaaaactacggttaaccctttttaccccacgtaaaccgtaagtacccgggtaagggggttacctaacgacggtaccttaaggtaaacgttagttttacgacgttaacttaacgttaattacgtaccaaacgtacggttaaccgtttacccgttcccggttacccccggtaacggttccggaccggtaaacggggtaaccgtaaggggtaacgtaaacgtaacgaaacggtaacgttacgtcggttcggtcgtacgaccgttccttattccgtcgttccttacctacttcccggttcccgcttaaccg

SEQ ID NO: 354220 - DNA, 673 bp, Homo sapiens
  misc_feature: GZ8MTXP01BDJ6F.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatccttcctgtctgcatctgtaggagacagagtcaccatcacttgccggcagtcaggacattaacagttatttagtctggtatcaagaacaaaaaccgagggaaactccctaaagctcctgatctatgttgctatcctatttgacgtaaaggtcgggtacccagtacgaaggttcccaggtcggcgtaaggtggtaaacgttcgtggggaacctaaggtaaactttccaaccttctacaaacctaaatccgaagccgaacggccctagggaccagtccttaaggaacttacgttttcaactttaaactttatttaaccgttgtaacctaaacgtagttaacctttaaacgttaaccggtttaaccccgctttaccggttaacgggtttccggggacgggtaaacgggggttaaccgaaagggggttggaaacgtaaacgttaaccgaaaacggttacgttggggttaacgccgttaagcccgtaaacttcgttccttaacggtttccc

SEQ ID NO: 354221 - DNA, 578 bp, Homo sapiens
  misc_feature: GZ8MTXP01DBUHX.13.8.A08.1.454.CMB.2.raw
  modified_base (191)..(191): a, c, t, g, unknown or other
  misc_feature (191)..(191): n is a, c, g, or t
  modified_base (264)..(264): a, c, t, g, unknown or other
  misc_feature (264)..(264): n is a, c, g, or t
  modified_base (362)..(362): a, c, t, g, unknown or other
  misc_feature (362)..(362): n is a, c, g, or t
  modified_base (513)..(513): a, c, t, g, unknown or other
  misc_feature (513)..(513): n is a, c, g, or t
  modified_base (564)..(564): a, c, t, g, unknown or other
  misc_feature (564)..(564): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtccaccgtctacttcggccgggacaagtcagacctattagaactaaatatagtaaatggaatacaanagacgcgaggtacgaacgcccctaagcctaccgtgactactatactgctatcccttagtttgcgacgggtcgggtacccagttaccggacgggttcgnggacgtaggtacggatcggtacgggaatacgtactttacactctacactacgtcactgtctcaccaactagagtctgactactaacttctaactcgaactacgtacgtaccgtacgtaccttacgtacttcgtcggacggacgggtaacgnggacgaggttactaacgtaacgaacggttcgttagggtctacgctaacccnttacttcgttcgtc

SEQ ID NO: 354222 - DNA, 795 bp, Homo sapiens
  misc_feature: GZ8MTXP01C7RHR.13.8.A08.1.454.CMB.2.raw
  modified_base (222)..(222): a, c, t, g, unknown or other
  misc_feature (222)..(222): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcattcgtgtaggagacagagtccaccgtcacgttggccggganaagtcagaccattagaactaaatatagtaaattggtatacaacagaacgccgaaggtacgaaacgcccctaagcctacctgatctaatactgaccacttcccttacgtttggtcgaacggggtcccggggtaccctaacgttaccccgtaaacggggtttccggtgggtaccgtagggttacgggtacttccgggttaggggtaaactaacgggtttactttaccaacctttcctaccctaaccctaactaccctaacccgtacgttacccgtaccgtaacccgtaaacccgttaggtaaacgtaccgttacgttaccggtaaccttaaacctttaaccgttaacccgtacggtaaacccctaaaccgttaaccgtttaaccccgtttaaacccggttaaacccgtttacccggttaaccgtttacccggtttttaccgggacccgggttaacgggggaacccgtacggggttacggttacgggaaacgtaaacgtaaaccgttaaaacggttaccgttacgggtaacgggtcctaaccgtaccgtacccttacgttccgttaacgtttcccc

SEQ ID NO: 354223 - DNA, 614 bp, Homo sapiens
  misc_feature: GZ8MTXP01BZI0O.13.8.A08.1.454.CMB.2.raw
  modified_base (216)..(216): a, c, t, g, unknown or other
  misc_feature (216)..(216): n is a, c, g, or t
  modified_base (400)..(400): a, c, t, g, unknown or other
  misc_feature (400)..(400): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgaacaaatatagtaaattggtatacaacagaagccaggtgaacgcccctaagctcctgactctatactgctactccctacgttttgcgagggtccggggtacccattccccgaagggttccgtaggacaggtaggatcgtaggggacagtactttcactctacacatcacntctgacctactagaactactgtagacctaacttacggttacctacgacctaaacgtagttacccgttaaccggtaaccttaccgttactaccgttttcgggaacccggtacggggaacccgtagggaccgttagggaacgtaacgtaaccgttaaaacggttccgttaggttaacggcctaacggtacccacgttacgttccttcgtttaaccc

SEQ ID NO: 354224 - DNA, 634 bp, Homo sapiens
  misc_feature: GZ8MTXP01EZ994.13.8.A08.1.454.CMB.2.raw
  modified_base (220)..(220): a, c, t, g, unknown or other
  misc_feature (220)..(220): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatcgacccagtctccatcctccctgtctgcatctgtaggagacagagtcaccgtcacgttggccggganaagtcacgacctattagaacaaatatagttaattgtaatacaacagaagccgtaaggtacgaacgtacccctaagccttcctagtacttacctatactgacctactccctaacgttttcggacgacgggtcccggggtacctagtaccgtaacgggttcgtggaccgaggtaggtactcggtagggactagtacttccactctacactactacactacgtctacgaacctaacgtagaacgtctagtacgacttaaaccttacgtactacgtaccaaactacggttaaccttaaccggtaaccttacgttaacttacggtttcggaccggtaacgggaacgtagttcgtacggaagacggtaacaaacggttacgttcggtggaccttgacctacttacgtccgttaacgttcc

SEQ ID NO: 354225 - DNA, 562 bp, Homo sapiens
  misc_feature: GZ8MTXP01AFRFU.13.8.A08.1.454.CMB.2.raw
  modified_base (218)..(218): a, c, t, g, unknown or other
  misc_feature (218)..(218): n is a, c, g, or t
  modified_base (259)..(259): a, c, t, g, unknown or other
  misc_feature (259)..(259): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtcctccatccctcctgtctgcatctgtaggagacagagtcaccgtcacttgccggganaagtcagaccattgaactaaatatagtaaattggtatcaanagaacgccgaggtagaacgcccctaagcctcctgatctatactgacatcctactttgcgaggtccgggtccagtccgaacggttcgtggcaggtaggatcgtgggactagtactttcgactctcacctatcacctagtcctagacctaactgaagcttgtcgactaacttactactacgacctaaacgtacgtaccgttaccgaaacccgttcgtaccttacgtttcggaccgtaggggaaccagggcgtggagtataccgaaacgttacgttggtcgacgtgccaccttagtccgttgtccc

SEQ ID NO: 354226 - DNA, 632 bp, Homo sapiens
  misc_feature: GZ8MTXP01B52O0.13.8.A08.1.454.CMB.2.raw
  modified_base (608)..(608): a, c, t, g, unknown or other
  misc_feature (608)..(608): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacgttcggccgggacaaagtcagaccattagaacaaatatagtaaattggtatacaacagaagccgaaggtacgaaacgcccctaagcctcctgactctatactgctatcctactttgtcgacggcggggtaccataccgaaggtttcggtggtcgaggtggtaactcggtagggtactagtactttcacttctaccacctataccacctagtctagacctaaccgtgaaacgcttgtacgtaactaaacctttaactaacgttacgaacctaaacgaacggtttacttaaacccggtaaccttaccgtaaccgttacgttttacgggcccgaaggggtaacccaagggttccgtaggaaacgtacgttaacgaaaacgttccgttagggtccgcggttaaccncctaacgttctcttaacggtttcc

SEQ ID NO: 354227 - DNA, 737 bp, Homo sapiens
  misc_feature: GZ8MTXP01BIZVQ.13.8.A08.1.454.CMB.2.raw
  modified_base (194)..(194): a, c, t, g, unknown or other
  misc_feature (194)..(194): n is a, c, g, or t
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtcctccatcctccctgtctgcatctaggtagganacagagtccaccgtcacttggccggganaagtcaagacctattgaactaaatntagtaaattggtaatacaaacagaagccgaaggtacgaaaccgtaccccctaaagcctaccgtagtactacttaactacgttagacctacttcccgttaagttttcggacggtaacgggggttcccggggtaccctaagttccccgttaaacgggttccggtagggaccctagggtagaacgttcggtaggggtaactagggttactttaccaacttctaccacctactacctacgactcgtacgtaccgaaccgttagaacgtaccgttacgtacgtaaccttaaccgttaccgtaacttaccggtaaccctaaacgttaacgttaacccgttaaccggttacccgttaaccgttaccgttaccgttttacggaccgggtaacgggtaaccgtacggttccggttaggacgtaaacgtaacgttaaaccgttacggttacggttaacggacgttaacgaccgtaaccttcgttaaccgttcgtttcccg

SEQ ID NO: 354228 - DNA, 655 bp, Homo sapiens
  misc_feature: GZ8MTXP01D8BSP.13.8.A08.1.454.CMB.2.raw
  modified_base (180)..(180): a, c, t, g, unknown or other
  misc_feature (180)..(180): n is a, c, g, or t
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
  modified_base (206)..(206): a, c, t, g, unknown or other
  misc_feature (206)..(206): n is a, c, g, or t
  modified_base (262)..(262): a, c, t, g, unknown or other
  misc_feature (262)..(262): n is a, c, g, or t
  modified_base (309)..(309): a, c, t, g, unknown or other
  misc_feature (309)..(309): n is a, c, g, or t
  modified_base (425)..(425): a, c, t, g, unknown or other
  misc_feature (425)..(425): n is a, c, g, or t
tcagtcacgtactacacgaccggtgctcgatttagcatactctacaggggggagtcagtctcagtcaggacacagcatggacatgagggtccccgctcagctcctgggctcctgctactctggctccgaggtgccagatgtgacatccagatgacccagtctccatcctccctgtctgcntctgtagagacngagtcncccgtacncgttggccggacaagtcaacgacctattagaactaatatagtaaatggtaatcaanagaagccaggtcgaacgtacccctaagcctcctgtactactaattcngtactactccctagtttcgtcgagggccggttaccactaccgtaacgggttcgtggactggtaagtactgttacgggacgtaatctttcgactctacccacattccgacacgttcngaacccctactagaaacgtgttcgtaactacttaaacttacgtcgtaacgtcctaccgagtttacccgttaaaccggttaccgtaaccgttaaccgtttacggttaccggaaccggggtaacgggaacgtaccgggttagtacggttaaacgttaaacgaaccggttaaaacgttacggttcggtaacggcgttaaccacgtaacccgttacgtcgttaacccgtttccg

SEQ ID NO: 354229 - DNA, 571 bp, Homo sapiens
  misc_feature: GZ8MTXP01D792I.13.8.A08.1.454.CMB.2.raw
  modified_base (190)..(190): a, c, t, g, unknown or other
  misc_feature (190)..(190): n is a, c, g, or t
  modified_base (355)..(355): a, c, t, g, unknown or other
  misc_feature (355)..(355): n is a, c, g, or t
  modified_base (423)..(423): a, c, t, g, unknown or other
  misc_feature (423)..(423): n is a, c, g, or t
  modified_base (507)..(507): a, c, t, g, unknown or other
  misc_feature (507)..(507): n is a, c, g, or t
  modified_base (547)..(547): a, c, t, g, unknown or other
  misc_feature (547)..(547): n is a, c, g, or t
  modified_base (554)..(554): a, c, t, g, unknown or other
  misc_feature (554)..(554): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccgtcacttggaccgggcaaagtcaagacctattgaacaaatatagtaaatggtaatacaaacagaagccgaggtagaaacgcccctaagctacctagactactatactgactactccctactttggcacggccgggtaccagtccgaaggttcgnggacaggttgatcgtgggaactagtactttcacgtctacacatacacatctagacctaaactaggaanactagtacgactaaacttacgtactactaccaacagtaccgttaacggaactacgtaacgtactttggacccgagggggaaccngggttacgtaggacgtaacttacgaaacgattgggtaagntaaccgnacccattcgttcgttcc

SEQ ID NO: 354230 - DNA, 555 bp, Homo sapiens
  misc_feature: GZ8MTXP01D9B2Z.13.8.A08.1.454.CMB.2.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (254)..(254): a, c, t, g, unknown or other
  misc_feature (254)..(254): n is a, c, g, or t
  modified_base (336)..(336): a, c, t, g, unknown or other
  misc_feature (336)..(336): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtnacttgccgggnaagtcagaccattgacaaatatgtaaatggtatcaaanagaagcaggtagaacgaccctaagctctgatctatactgcatcctatttgacgagggccgggtaccataccgaacggttcgnggcaggtaggatcgtagggaactagtatttcactctacaaccatacacgagtctagacaactagaagactagtagactaaacttaacttaactacgaccaaactacgtacgttaaccgtaaccgtaccgtacgtacgttacgtaccggacgggaaccggacggacgtacggagaagtaacaaacgaacgttagtggtcgtcgacaccactcgttcgttc

SEQ ID NO: 354231 - DNA, 708 bp, Homo sapiens
  misc_feature: GZ8MTXP01BT5VE.13.8.A08.1.454.CMB.2.raw
  modified_base (217)..(217): a, c, t, g, unknown or other
  misc_feature (217)..(217): n is a, c, g, or t
  modified_base (260)..(260): a, c, t, g, unknown or other
  misc_feature (260)..(260): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgaccgganaagtcagaccattgaactaaatatagtaaattggtatacaaanagaacgccgaaggtacgaaacgaccccctaagcctacctgactctatactgactactccctagttttcggcgtacggggtccggggtacccctaagttaccccgtaacggggtttccggtaggccgtaggttaagggacttcgggtaggggaactagttactttccactctacccaacctactacccaccgtagtccagaaccctaaaccgtagtaaacgtacttcggtaactaacttaaaccgtttaactaaccgtacggtaaccctaaacgtacggttaacccttaaccgggtaaaccttacgttaaccgtttaccggtttacggggaccggtaaccgggggtaaccacggggttacggtaacgggaacgtaaacgtaaccgaaaaccggttacgttcgggtaaccggtcgtaacggaccctaaccttcgtttcttaacggttccc

SEQ ID NO: 354232 - DNA, 741 bp, Homo sapiens
  misc_feature: GZ8MTXP01DBVFC.13.8.A08.1.454.CMB.2.raw
  modified_base (221)..(221): a, c, t, g, unknown or other
  misc_feature (221)..(221): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaccgtcacgttggccggganaagtcagacctattagaactaaatatagtaaattggtatacaacagaacgccgaaggtacgaaaccgccccctaaagccttcctagtacttactaatactgactacttcccttaacgtttcggcgacggggtccggggtaccctaacgttacccggtaacggggtttccggtggaccgtagggttagggtaacgttcggtacgggggaaactaaggttacttttaccgaaccttcctaaccctaaccctacttacccaacccgtaacggttccttacgaacccgtaaaccgttaggaaaacggtaccttgtaaccgtaaccttaaacctttaaccggtaaccgttacgaaaccctaaacgtacggttaaccgttaaccggtaacctttaccgtaaccgttacggtttccgggaacccggtaacgggggaaccctagggttacgtagggaacgtaacgttaaaccgaaacggttcgttcggttaacggacttcgaccctacttacttcgttcgtttaaccc

SEQ ID NO: 354233 - DNA, 690 bp, Homo sapiens
  misc_feature: GZ8MTXP01APF3S.13.8.A08.1.454.CMB.2.raw
  modified_base (223)..(223): a, c, t, g, unknown or other
  misc_feature (223)..(223): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatcgacccagtcctccatccctccctgtctgcatctgtaggagacagacgtcaccgtcacgttggccggganaagtcagacctattagaactaaatatagtaaattggtaatacaacgagaacgccgaggtacgaacgtcccctaagtcctcctgtactactatactgactactcctatttcgcgacgggccggtcagtacccgtacggttcgtaggctggtaggactcgtagggactagtactttccatctacactactaccgaccgtagtcctaggaaccctaaaccgtaggtaaacgtccgttagggtaccgtaaaccgttaaaccgttaccggttaaccttaccgggaacccctaaacggttaaccgttacccgttaaacccgtaccgtttacccggtaaactttcccgggttttacgggaacccgggttacgggggtaaacccggtcgggttacgggtacgaacggtaaaccgtaaccggttaaacgttcgttacggtaacgtctaaccgacctacgttcttcgttcgttaacc

SEQ ID NO: 354234 - DNA, 526 bp, Homo sapiens
  misc_feature: GZ8MTXP01EM385.13.8.A08.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
  modified_base (398)..(398): a, c, t, g, unknown or other
  misc_feature (398)..(398): n is a, c, g, or t
  modified_base (415)..(415): a, c, t, g, unknown or other
  misc_feature (415)..(415): n is a, c, g, or t
  modified_base (480)..(480): a, c, t, g, unknown or other
  misc_feature (480)..(480): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacgtcacttgccggganaagtcaagaccattgaactaaatatagtaaattggtaatcaaacagaagtccgaaggtagaacgcccctaagctacctgactntatactncactcctactttgacgagggcgggtaccagtcgaaggttcgtgcagtgggaatcgtagggactagtactttcactgtacactagcacgatcngacaactagacgattgnactaactacgtactacgacaacacgtacgtacgtactacgtactacgttcgtcgacggaacgagngtagagataacgaacgacgttacgtgcgtaacacacactcttcgtc

SEQ ID NO: 354235 - DNA, 487 bp, Homo sapiens
  misc_feature: GZ8MTXP02FOEEA.13.8.A08.1.454.CMB.2.raw
tcagtcacgtactacacgaccggtgctcgatttagcatactctacaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcgggtcccatccaaggttccgtggcagtggatcgtgggacagatttcactctcacatcacagtctgcaacctgaagactgtcgacaaacttactactgccaaacagtacttacggacctcgtacactttggccaggggaccaggctggacgatcaaacgactgtggctgcaccatctgtc

SEQ ID NO: 354236 - DNA, 503 bp, Homo sapiens
  misc_feature: GZ8MTXP02GNFQR.13.8.A08.1.454.CMB.2.raw
  modified_base (214)..(214): a, c, t, g, unknown or other
  misc_feature (214)..(214): n is a, c, g, or t
tcagtcacgtactacacgaccggtgctcgatttagcatactctacaggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgaacaaatatgtaaattggtatcaaacagaagccaggtgaagcccctaaagctcctgatctatactgcatccactttgtcaggcgggtccatccaaggttccgtggcagtggatcgtgggacagatttcactctcaccatcaccagtctgcaacctgaagactgtgacaaacttactactgaccaaacagtacttaacggaaccttcgtaactacgtttggaccaggggaccaggctggagactacgaaacgaactgtaaggctgcaccatctgtc

SEQ ID NO: 354237 - DNA, 606 bp, Homo sapiens
  misc_feature: GZ8MTXP02GKAVG.13.8.A08.1.454.CMB.2.raw
  modified_base (204)..(204): a, c, t, g, unknown or other
  misc_feature (204)..(204): n is a, c, g, or t
  modified_base (238)..(238): a, c, t, g, unknown or other
  misc_feature (238)..(238): n is a, c, g, or t
  modified_base (254)..(254): a, c, t, g, unknown or other
  misc_feature (254)..(254): n is a, c, g, or t
  modified_base (258)..(258): a, c, t, g, unknown or other
  misc_feature (258)..(258): n is a, c, g, or t
  modified_base (262)..(262): a, c, t, g, unknown or other
  misc_feature (262)..(262): n is a, c, g, or t
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (285)..(285): a, c, t, g, unknown or other
  misc_feature (285)..(285): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtnacttcgacgggcaagtcagaccgattgacaaatntgtaaatggatcaaanagancagnacncctanctcnatctatacgtncactctacttcgtacgacggcggtaccgtactaccgtacggtccgtcggacgtaggtagtagtcgtacggacgtacgtacttactactacctaccacctactacctacctacgtactacgactaacctacgaacgtacgtacgtacgtactaaacttaactacgtacgacctaacgtaacgtaccgttaaccgtaaccgttacgttaacgttacgttacggtaccggtacgggtaaccggtacggtacggtacggtaacgtaacgtaacgtaaacgtaacgtacggtaacgtacgtacgacgacgtacgtacgttacgtcg

SEQ ID NO: 354238 - DNA, 489 bp, Homo sapiens
  misc_feature: GZ8MTXP02IFULG.13.8.A08.1.454.CMB.2.raw
tcagtcacgtactacacgaccggtgctcgatttagcatactctacagggggagtcagtctcagtcaggacacagcatggacatgagggtcccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgcaggcggggtcccatccaaggttccgtggcagtggatcgtgggacagtatttcactctcaccatcacagtctgcaacctgaagactgtgacaacttactactcgaccacagtcttacggaactcgtacactttgcagggtacaggctaggagactcaaaacgactgtaaggctgcacactctgttac

SEQ ID NO: 354239 - DNA, 571 bp, Homo sapiens
  misc_feature: GZ8MTXP02HA2WX.13.8.A08.1.454.CMB.2.raw
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacttgccgggcaagtcagaccattgacaaatatgtaaattggtatcaacagaagccaggtgaagcccctaagctcctgatctatactgcatccactttgtcagggcggggtcccatcccgaaggttccgtggcagtggatcgtgggacagtatttcactctcaccatcacagtctgacaaccctgaaacgactgtacgactaaactttactacttgacccaaacgagttaccttaaccggaacccttacgtaaccttacgttttacggacccgtaacgggggtacccgaggtccgtacggaagaacgtaccgaaaaacgtaaccgttggtaacgggactacggaccaacctacttacctacgtttccc

SEQ ID NO: 354240 - DNA, 490 bp, Homo sapiens
  misc_feature: GZ8MTXP02HDEDX.13.8.A08.1.454.CMB.2.raw
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaaacagaagccaggtgaagcccctaagctcctgatctatactgcatccactttgcaggcgggtccatccaaggttcctggcagtggatcgtgggacagatttcactctcaccatcaccagtctgcaacctgaagactgtgacaaacttactactgaccaacagtctaacggaactcgtacactttggacaggggaccaggctaggagactacgaaaacgaactgtgctgcaccatctctc

SEQ ID NO: 354241 - DNA, 572 bp, Homo sapiens
  misc_feature: GZ8MTXP02JYXO4.13.8.A08.1.454.CMB.2.raw
  modified_base (361)..(361): a, c, t, g, unknown or other
  misc_feature (361)..(361): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtccatccaaggtccgtggcagtgatcgtgggacagattcactctcacntcaccagtctgacaacctgaacgactgtcactaaacttactactgaccaaacgtagtacttaacccgggaaccttacggtaacttaccgtttttacggggaccccgtaacgggggtacccaaggggtccgtagggaacggacttaccgaaaaaccggaaccgtttaggcggggttacctacgaccctaacctacgtttaccgtcgtttacc

SEQ ID NO: 354242 - DNA, 563 bp, Homo sapiens
  misc_feature: GZ8MTXP02FXRLG.13.8.A08.1.454.CMB.2.raw
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatagtaaattggtatcaaacagaagccaggtgaacgcccctaagctcctgatctatactgcatccactttgcgaggcgggtcccatccaaggttccgtggcagtggatcgtgggacagtatttcactctcacatccacagtctgacacctagaagactgtcactaaacttactactacgacccaacgacgttaccgttaaccggaaccttcgtaacttaccgttttacgggacccgaacgggggtaacccaggggccgttacgggaaattaacgtaccgaaaaaccgacgttaggtcggctacgacctaacctcgtaccttacgttcc

SEQ ID NO: 354243 - DNA, 535 bp, Homo sapiens
  misc_feature: GZ8MTXP02F2YSY.13.8.A08.1.454.CMB.2.raw
  modified_base (204)..(204): a, c, t, g, unknown or other
  misc_feature (204)..(204): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtnacttgccgggcaagtcagaccattgacaaatatgtaaattggtatcaacagaagccaggtgaagcccctaaagctcctgatctatactgcatccacttgtcaggcgggtcccatccaaggttccgtggcagtggatcgtgggacagattcactctcaccatcaccagtctgcaacctgaagactgtgacaacttactactgacccaaacagtaccgtttaacggaaaccttcgtacctaacgttttcgggaccaacgggggacccaagggccttacgggaagtaactaccgaaaaacgaactggtggcttacggcaaccattcctgtttcc

SEQ ID NO: 354244 - DNA, 552 bp, Homo sapiens
  misc_feature: GZ8MTXP02FM9TK.13.8.A08.1.454.CMB.2.raw
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgaacaaatatagtaaattggtatcaaacagaagccaggtgaagcccctaagctcctgatctatactgcatccactttgtcaggcggggtcccatccgaaggttccgtggcagtggatcgtgggacagtatttcaatctcaccatcacagtctgacaacctgaaagctgtcgactaacttactactgacccaaactagttccttaacggaaccttcgtaactacgttttcggaccgaagggggacccagggcctacgggagaacgttaccgaaaaacggaacttggaacggcttacggacctaacccgtattccttttccttacc

SEQ ID NO: 354245 - DNA, 541 bp, Homo sapiens
  misc_feature: GZ8MTXP02IK187.13.8.A08.1.454.CMB.2.raw
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacttgccgggcaagtcagaccattgacaaatatgtaaattggtatcaaacagaagccaggtgaagcccctaagctcctgatctatactgcatccactttgcaggcggggtcccatccaaggttccgtggcagtggatcgtgggacagatttcactctcaccatcaccagtctgacaacctgaacgactgtgacaactttactaacttgaccaacacgtacttaacggaaccttacgtactacgttttcggaccgtacgggggacctagggccgttaggaacgacgtaccgaaaacgtaacctaggttcggcgtacggacacctactccttagtttccc

SEQ ID NO: 354246 - DNA, 582 bp, Homo sapiens
  misc_feature: GZ8MTXP02JZQRZ.13.8.A08.1.454.CMB.2.raw
  modified_base (216)..(216): a, c, t, g, unknown or other
  misc_feature (216)..(216): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgaacaaatatagtaaattggtatcaacagaagccaggtgaacgcccctaagcctcctgatctatactgcatccactttgcaggcgggtcccagtccgaaggttcgtggcaggtggatcgtgggacagtatttcactctcaccatcaccagtctgacaacctgaacgactgtcgactaaaccttactactgacccaaactacgttaccttaaccgggaacccttacgttaacctaccgttttacgggacccgtaacgggggtacccaggggtccgtagggaacgtaacgtaccgaaaaccggtaacgttgggtaacgggccttacggacctaacctacgttccgtttacgtacc

SEQ ID NO: 354247 - DNA, 548 bp, Homo sapiens
  misc_feature: GZ8MTXP02HFQET.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttggccgggcaagtcagaccattgacaaatatagtaaattggtatcaaacagaagccaggtgaacgcccctaagctcctgatctatactgcatcctactttgtcgagggtccgggtcccatccgtaacggttccgtggcagtggatcgtgggacagtattcactctcacatccactagtctgacaaccgtgaacgtactgtacgactaaactttactactacgacctaactacgttaccgtaaccggaaccttcgtactacgtttacggaccgaggggtaccaggtcgtaggacgaataccgaaaacgtacgtggtcggctacgaccactactcgtcttac

SEQ ID NO: 354248 - DNA, 502 bp, Homo sapiens
  misc_feature: GZ8MTXP02HP6AJ.13.8.A08.1.454.CMB.2.raw
  modified_base (460)..(460): a, c, t, g, unknown or other
  misc_feature (460)..(460): n is a, c, g, or t
  modified_base (495)..(495): a, c, t, g, unknown or other
  misc_feature (495)..(495): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaaacagaagccaggtgaagcccctaaagctcctgatctatactgcatccatttgtcaggcggggtccatccaaggttccgtggcagtggatcgtgggacagatttcactctcacatcacagtctgacaacctgaagactgtgctaaacttactacttgaccaacagtacttacggaacctcgtactactttggcctaggggaccaggtcnggagactacgaaaacgaactgtggctagcactacncttgttc

SEQ ID NO: 354249 - DNA, 571 bp, Homo sapiens
  misc_feature: GZ8MTXP02HEXO6.13.8.A08.1.454.CMB.2.raw
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaaacagaagccaggtgaacgcccctaagctcctgatctatactgcatccactttgtcaggcgggtccagtccaaggttccgtggcagtggatcgtgggacagtatttcactctcaccatcacagtctgcaacctgaacgactgtgactaacttactactcgaccaacacgtaccgttacggaaccttacgtaactacgttttacggacccgtacgggggtacccgagggtacgttacgggaacgtaacgttaccgaaaaccggtaaccgtaggtaacgggtccgttacggaccctaacccgaacttccgttacggtttccc

SEQ ID NO: 354250 - DNA, 555 bp, Homo sapiens
  misc_feature: GZ8MTXP02IHWE6.13.8.A08.1.454.CMB.2.raw
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacttgccgggcaagtcagaccattgaacaaatatgtaaattggtatcaaacagaagccaggtgaaagcccctaaagctcctgatctatactgcatccactttgcaggcggggtccatccaaggttccgtggcagtggatcgtgggacagtattcactctcactatcacagtctgacaaccgtagaacgtctgtacgacctaaacttactaactcgaccctaaacgacttccgtaacggaacctcggttaaccttacgtttcgggacccgtaaggggccgaggtcgtaggacgtaactaccgaaaacgtaactggtaacggctacggactaaccgtacttccgttgtttaccc

SEQ ID NO: 354251 - DNA, 538 bp, Homo sapiens
  misc_feature: GZ8MTXP02HBUW6.13.8.A08.1.454.CMB.2.raw
  modified_base (514)..(514): a, c, t, g, unknown or other
  misc_feature (514)..(514): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaacgcccctaagctcctgatctatactgcatccactttgtcaggcggggtcccagtcccgtaaggttccgtggctagtggatcgtgggacagtatttcactctcaccatccaccagtctgcaacctggaacactgtgactaaacttactactagcctaacagtacctttaacggaaccctcggtaactacgttttacggaccgaggggaacccagggtcgtacggagacttaccgaaaacgtaacttgnggtctcgacacctatccttgttcc

SEQ ID NO: 354252 - DNA, 531 bp, Homo sapiens
  misc_feature: GZ8MTXP02FTGSN.13.8.A08.1.454.CMB.2.raw
  modified_base (215)..(215): a, c, t, g, unknown or other
  misc_feature (215)..(215): n is a, c, g, or t
  modified_base (282)..(282): a, c, t, g, unknown or other
  misc_feature (282)..(282): n is a, c, g, or t
  modified_base (330)..(330): a, c, t, g, unknown or other
  misc_feature (330)..(330): n is a, c, g, or t
  modified_base (512)..(512): a, c, t, g, unknown or other
  misc_feature (512)..(512): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgacaaatatagtaaattggtatcaacagaagccaggtgaagcccctaagctccngatctatactgcatccactttgtcaggcgggtccatccaaggttccgnggcaggtggatcgtgggacagatttcactctcaccatccaccagtctgaccaacctgaaactctagtgacctaaactttacctaactcgacccaaacgtcgttaccttacggaacctcgttaactcgtttaggcctaggggacccagggctaggagacttacgaaaaccggattgcggtacncgacctactactctcgtac

SEQ ID NO: 354253 - DNA, 587 bp, Homo sapiens
  misc_feature: GZ8MTXP02G4ITR.13.8.A08.1.454.CMB.2.raw
  modified_base (216)..(216): a, c, t, g, unknown or other
  misc_feature (216)..(216): n is a, c, g, or t
tcagtcacgtactacacgaccggtgctcgatttagcatactctacaggggggagtcagtctcagtcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggnaagtcagggcattagaaatgatttaggctggtatcagcaagaaaccagggaaacgcccctaagctcttgatctatggtgcataccgtaaggtttaaaaacggtcggggttacccaagttacgaacgggtttcgaaggcggacgaggttggatcgtcggcacgagtacttcacttctacacatacagcagcctgacacgctagacgtatttgactaactttatactgtactaacaagtactacaactaattacgtaccgtacggggtaccggtttaccgggaaccggaaaacgggggtaacccgaaaaggggttacgggaaaacttaccgaaaacgtaacgttggtacgggactcggacctacaactttccg

SEQ ID NO: 354254 - DNA, 576 bp, Homo sapiens
  misc_feature: GZ8MTXP02HSFK9.13.8.A08.1.454.CMB.2.raw
  modified_base (337)..(337): a, c, t, g, unknown or other
  misc_feature (337)..(337): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgaacaaatatgtaaaattggtatcaaacagaagccaggtgaacgcccctaagctcctgatctatactgcatcctactttgcagggcgggtcccatccgaaggttccgngcagtggatcgtagggacagtatttcactctacaccatcaccagtctgtaccaaacctgaaacgactgtacgactaaacctttacacttgaccctaaacgtacgttaccttaaccgggaacccttacggtaacctacgttttacggacccgtaacggggtaccaacggtcgtacggaagtactaacgaaaaccgtaactggtaacggtctacggacccaaccgtacttcccttgttccc

SEQ ID NO: 354255 - DNA, 531 bp, Homo sapiens
  misc_feature: GZ8MTXP02HLWPE.13.8.A08.1.454.CMB.2.raw
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgaacaaatatgtaaattggtatcaaacagaagccaggtgaaacgcccctaaagctcctgatctatactgcatccactttgcaggcgggtcccatccgaaggttccgtggcagtggatcgtgggacagtatttcactctcacatcacagtctgcaacctgaacgactgcgactaacttactactgacccaaactacgttaccttaacggaaccttcgtactacgttttacggccgtaagggggaccagggctagggacacgtacgaaaacgtaatcggtaaggactcgactaccatccttgtcc

SEQ ID NO: 354256 - DNA, 531 bp, Homo sapiens
  misc_feature: GZ8MTXP02IF6HO.13.8.A08.1.454.CMB.2.raw
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaaacagaagccaggtgaagcccctaagctcctgatctatactgcatccactttgcaggccgggtccatccaaggttccgtggcagtgatcgtgggacagtatttcactctcaccatcaccagtctgcaacctgaacgactgtgactaaactttactacttgaccaacgacgttccttaacggaaccttcggtaactacgttttacgggccgtacggggaccaggaccttgggaagtaactacgaaaacgtactaggtcggactcgacactactctagttcc

SEQ ID NO: 354257 - DNA, 548 bp, Homo sapiens
  misc_feature: GZ8MTXP02IGZ4J.13.8.A08.1.454.CMB.2.raw
  modified_base (191)..(191): a, c, t, g, unknown or other
  misc_feature (191)..(191): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccgtcacttggccgggcaagtcagaccattgacaaatatagtaaattggtatacaacagaagccaggtagaacgcccctaagctcctgatctatactgcatccactttgacaggcggggtaccatccgaagttccgtggctaggtgatcgtgggacagtatttcactctcacatcaccagtctgacaacctagaacgactgtacgactaacttactactgaccaactagttaccgtacggaaccttcgtaacgttacgtttacggaccgaggggacccaggccgtaggacgaactacgaaacggtaacctgggtaacgacgtacgactaccctacgtccttacgttcc

SEQ ID NO: 354258 - DNA, 581 bp, Homo sapiens
  misc_feature: GZ8MTXP02HVYAO.13.8.A08.1.454.CMB.2.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (369)..(369): a, c, t, g, unknown or other
  misc_feature (369)..(369): n is a, c, g, or t
  modified_base (548)..(548): a, c, t, g, unknown or other
  misc_feature (548)..(548): n is a, c, g, or t
  modified_base (561)..(561): a, c, t, g, unknown or other
  misc_feature (561)..(561): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctggtagganacagagtcaccgtcacttgccggganaagtcagaccattgaacaatatagtaaattggtatacaacaagaagccgaggtagaacgcccctaagctcctgtatctatactgctactcctactttgtcacggggtccgggtccatccgaacggttccgtggcagtggatcgtagggacngtactttcactctacactactcacctaggtctacgacaaaccctagaacgtactaggtcaaaccttaacttacctaacgttcgaaccctaacgtacgttaccgtaaacggtaccctacgtacttaccgtttggcccgtaaggggaccacggtcgtagagaactaacgaaacgttaacgnggtaacgcgtacncctaacgtcttcgttcttcc

SEQ ID NO: 354259 - DNA, 536 bp, Homo sapiens
  misc_feature: GZ8MTXP02HCU59.13.8.A08.1.454.CMB.2.raw
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatagtaaattggtatcaacagaagccaggtgaacgcccctaagctcctgatctatactgcatccatttgcaggcgggtcccatcccaaggttccgtggcagtggatcgtgggacagtatttcactctcaccatccaccagtctgacaacctgaacgactgtcgactaaaccttactactacgacccaactacgttaccttaaccggaaccttacggtactacgttttacggccgaacgggggaccaggctacggagacgtacgaaaacgacttaggcggctcggacaacctactcgtcgtc

SEQ ID NO: 354260 - DNA, 559 bp, Homo sapiens
  misc_feature: GZ8MTXP02GMW7J.13.8.A08.1.454.CMB.2.raw
  modified_base (216)..(216): a, c, t, g, unknown or other
  misc_feature (216)..(216): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccgtcacttgccgggnaagtcagaccattgaacaaatatagtaaattggtatcaaacagaagccaggtgaacgcccctaagctctgatctatactgcatccactttgtcgaggccggggtacccagtccgaaggttccgtggcaggtggatcgtgggacagtatttcactctacacatcactagtctgacaacctgaacgtacgtagtcgactaaacttactaacgttacgacccaaacgtacgtacccgtttaaccggaacccttacgtaaccttacgttttacgggaccgtaacggggaccgaggaccgtaggagaactacgaaaacgaactgaaggctcgacacctatctgttacc

SEQ ID NO: 354261 - DNA, 510 bp, Homo sapiens
  misc_feature: GZ8MTXP02HOSW8.13.8.A08.1.454.CMB.2.raw
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgaacaaatatgtaaattggtatcaacagaagccaggtgaagcccctaagctcctgatctatactgcatccactttgtcaggcgggtccatccaaggttccgtgcagtggatcgtgggacagatttcactctcacatcacagtctgcaacctgaagactgtagacaacttactactgaccaacagtcttaacggaacttcgtactacgtttcggaccgaggggaccaggctaggacgtacgtacgaaaacgtaaccgtgtcggactcgacacctatctgttcc

SEQ ID NO: 354262 - DNA, 567 bp, Homo sapiens
  misc_feature: GZ8MTXP02G9T6R.13.8.A08.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (283)..(283): a, c, t, g, unknown or other
  misc_feature (283)..(283): n is a, c, g, or t
  modified_base (330)..(330): a, c, t, g, unknown or other
  misc_feature (330)..(330): n is a, c, g, or t
  modified_base (364)..(364): a, c, t, g, unknown or other
  misc_feature (364)..(364): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggnaagtcagaccattgacaaatatgtaaattggtatcaacagaagccaggtgaacgcccctaagctccngatctatactgcatccactttgcaggcgggtccatccgaagttccgngcagtggatcgtgggacagtattcactctcaccntccacagtctgacaacccgagaactacgtagcaaccttaacttaacctacgtacaacctaacgtacgttaacccgttaaccgtaacccgttacgttaaccttacggtttaccggaccgggtaacggaccgtacggtacgtacggtaacgaacgttaaccgaaaacgtacgtaggcgtcacgtaccactactcgttcgtttacc

SEQ ID NO: 354263 - DNA, 525 bp, Homo sapiens
  misc_feature: GZ8MTXP02FI776.13.8.A08.1.454.CMB.2.raw
  modified_base (358)..(358): a, c, t, g, unknown or other
  misc_feature (358)..(358): n is a, c, g, or t
  modified_base (413)..(413): a, c, t, g, unknown or other
  misc_feature (413)..(413): n is a, c, g, or t
  modified_base (434)..(434): a, c, t, g, unknown or other
  misc_feature (434)..(434): n is a, c, g, or t
  modified_base (470)..(470): a, c, t, g, unknown or other
  misc_feature (470)..(470): n is a, c, g, or t
  modified_base (479)..(479): a, c, t, g, unknown or other
  misc_feature (479)..(479): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattagacaaatatagtaaattggtatacaacagaagccaggtgaacgccctaagctcctgatctatactgcatccactttgtcacgggcggggtccccataccgtaaggtttccgtggctaggtggacttcgnggggacagtatttacactactcaacctatcaccagtctgaccactagaagctagngacaacttactactgaccaanattctaacggactcgtactgtttcgacgacggaccnggctagganataccgaaaacgacgtagtcggctacgacacctactcgtacgttcc

SEQ ID NO: 354264 - DNA, 593 bp, Homo sapiens
  misc_feature: GZ8MTXP02GK6HF.13.8.A08.1.454.CMB.2.raw
  modified_base (217)..(217): a, c, t, g, unknown or other
  misc_feature (217)..(217): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccgtcacttgccgggnaagtcagaccattgaacaaatatgtaaattggtatcaaacagaagccaggtgaagcccctaagctcctgatctatactgcatccactttgcaggcgggtccatccgaaggttccgtggcagtggatcgtgggacagtattcactctcaccatccacagtctgacaacctgaacgtactgtgacctaaacttactactcgacccaaactagttaccgttaacgggaaccttcggtaaccttacgttttcgggaccccgtaacgggggaccctaaggggtccttacgggggaaactaacgttaaccgaaaaaccggtaaccgtgggtaacgggtacccttacggaccctaacccgtaacgttcctttacggtttaccc

SEQ ID NO: 354265 - DNA, 553 bp, Homo sapiens
  misc_feature: GZ8MTXP02JI689.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgaacaaatatgtaaattggtatcaacagaagccaggtgaacgcccctaagctcctgatctatactgcatcctactttgtcaggcgggtccatccaaggttccgtggcagtggatcgtgggacagtattcactctcacatcacagtctgacaacctagaacgtactgtacgacctaaacttacctacgtacgaccctaaactacgttaccgttaaccggtaacccttcgtaacctacgtttttacgggacccgtaacggggacccgaggccgtagggagtactacgaaaacgtacgtagtggctacggacacacttcacgtttcc

SEQ ID NO: 354266 - DNA, 557 bp, Homo sapiens
  misc_feature: GZ8MTXP02HW3BH.13.8.A08.1.454.CMB.2.raw
  modified_base (217)..(217): a, c, t, g, unknown or other
  misc_feature (217)..(217): n is a, c, g, or t
  modified_base (383)..(383): a, c, t, g, unknown or other
  misc_feature (383)..(383): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaccgtcacttggccgggnaagtcagaccattgaacaaatatgtaaattggtatacaacagaagaccaggtgaacgcccctaagctcctgatctatactgcatcctatttgcagggcggggtccatccgaaggttccgtggcagtggatcgtgggacagtattcactctacaccatcaccagtcncgacaacctgaaagactgtacgactaaaccttactacttacgacctaactacgttacgttaaccggaaccttcgtactacgtttcggacgtaacggggaccaggtcgtcggaagactaaccgaaacgtaacgtggtaacggtcctacggacctaacctacttcgttacgtttcc

SEQ ID NO: 354267 - DNA, 500 bp, Homo sapiens
  misc_feature: GZ8MTXP02I3WEY.13.8.A08.1.454.CMB.2.raw
  modified_base (190)..(190): a, c, t, g, unknown or other
  misc_feature (190)..(190): n is a, c, g, or t
  modified_base (417)..(417): a, c, t, g, unknown or other
  misc_feature (417)..(417): n is a, c, g, or t
  modified_base (431)..(431): a, c, t, g, unknown or other
  misc_feature (431)..(431): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggcaagtcagaccattgacaaatatgtaaattggtatcaaacagaagccaggtgaagcccctaagctcctgatctatactgcatcccactttgtcaggcggggtccatccaaggttccgtggcagtggatcgtgggacagatttcactctcaccatcacagtctgacaacctgaagtatttgctaaactttattactgtacaacngtatttcagtacgngacgtgacagggacctaaggtgaaatcgaaaacgactgtacggctagctaccatctgtcttcactttcc

SEQ ID NO: 354268 - DNA, 500 bp, Homo sapiens
  misc_feature: GZ8MTXP02GCFG2.13.8.A08.1.454.CMB.2.raw
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtccatccaaggttccgtggcagtggatcgtgggacagatttcactctcaccatcaccagtctgcaacctgaaacgactgtgactaaacttactactgaccaacagtacttacggaactcgtacactttggcctaggggaccaggcgtggagatacgaaaacgactagtggactgcaccatctgttcc

SEQ ID NO: 354269 - DNA, 568 bp, Homo sapiens
  misc_feature: GZ8MTXP02I3BVB.13.8.A08.1.454.CMB.2.raw
  modified_base (423)..(423): a, c, t, g, unknown or other
  misc_feature (423)..(423): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatccctccctgtctgcatctggtaggagacagagtcaccgtcacgttgccgggcaagtcagaccattgaacaaatatagtaaattggtatcaaacagaacgccaggtagaacgcccctaagcctcctgatctatacctgcatccctactttgtcgagggccggggtacccagtccgtaacggttccgtggctagtggatcgtgggacagtatttcactctcacctatccactagtctgaccacctgaacgtactgtanactaactttactacttgacccaactacgttaccgttaacggaaccttcgtaacttacgtttacgggaccgtacggggaccaggcgtagggacgtaactacgaaaacgtacgttggcggtctacgacaccgtattcgttactttcc

SEQ ID NO: 354270 - DNA, 557 bp, Homo sapiens
  misc_feature: GZ8MTXP02FTPT6.13.8.A08.1.454.CMB.2.raw
tcagtcacgtactacacgaccggtgctcgatttagcatactctacaggggagtcagtctcagtcaggacacagcatggacatgagggtccccgctcagctcctggggctcctgccactctggctccgaggtgccagatgtgacatccagatgacccagtctccatcctcctgtctgcatctgtaggagacagagtcaccgtcacttgccgggcaagtcagaccattgacaaatatagtaaattggtatcaacagaagccaggtgaagcccctaagctcctgatctatactgcatccactttgtcaggcggggtcccatccaaggttcctggcaggtggatctggggacagatttcactctcaccatcacagtctgcaacctgaagactgtgacctaaacttactaactcgacccaaactagttccttaacggaaccttcggttaaccactttttcggacccgtaagggggtaccccagggtaccttggggaaacgtacgttaccgaaaacggaaccttaggtcgggtacttcggacaccctaatccgttgtttaccc

SEQ ID NO: 354271 - DNA, 522 bp, Homo sapiens
  misc_feature: GZ8MTXP02GRZGP.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacttgccgggcaagtcagaccattgacaaatatagtaaattggtatcaaacagaagccaggtgaagcccctaagctcctgatctatactgcatccactttgtcaggcgggtccatccaaggttccgtggcagtggatcgtgggacagtatttcactctcacatcacagtctgacaacctgaagactgtgactaaacttactactcgtaccaaactacgttaccttaacggaaccttcgtaactacgtttcggccgtaaggggaccaggctaggaagactacgaaaacgactgtaaggctacgacaccactctgttacc

SEQ ID NO: 354272 - DNA, 504 bp, Homo sapiens
  misc_feature: GZ8MTXP02GSZYR.13.8.A08.1.454.CMB.2.raw
  modified_base (190)..(190): a, c, t, g, unknown or other
  misc_feature (190)..(190): n is a, c, g, or t
  modified_base (366)..(366): a, c, t, g, unknown or other
  misc_feature (366)..(366): n is a, c, g, or t
  modified_base (468)..(468): a, c, t, g, unknown or other
  misc_feature (468)..(468): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggcaagtcagaccattgaacaaatatgtaaattggtatcaacagaagccaggtgaagcccctaagctctgatctatactgcatccactttgcaggccgggtcccagtccaaggttccgtggcaggtgatcgtgggacagatttcactctcaccntccacagtctgacactgaacgctgcgacaacttacatcgaccaaagtagtccttaaccggaacctcgtactacgtttagccgaacggggaccaggctagganactacaaaacgtactgtggctacgacaccatctgtc

SEQ ID NO: 354273 - DNA, 562 bp, Homo sapiens
  misc_feature: GZ8MTXP02JM8WP.13.8.A08.1.454.CMB.2.raw
  modified_base (393)..(393): a, c, t, g, unknown or other
  misc_feature (393)..(393): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgaccctagtctccactactactccctccgtctcgtcactctgtaggaggacgagagtcaccgtccgacttgtccgggccgaagtacgacgaccacttgtacaaataatgtaaattagtagtacaacagaagacacgtgaagacccctaacgatcctcgagtctataactcgcactcctactttcgttcgtacggcggggtcccgtaccctcgtaacggttaccggttcggcgacgtagggngtactgggtacgacgtagtttctactctcaccactcaccagtctgccaactacgagactgtagctaaacttactactcgacaaaccagtcttaacgaacctactactactttcggcgacgggacgtagcgtaggacgactacgaacgaacgtgtgctcgcacactctcg

SEQ ID NO: 354274 - DNA, 551 bp, Homo sapiens
  misc_feature: GZ8MTXP02GU2YM.13.8.A08.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggnaagtcagaccattgaacaaatatgtaaattggtatcaaacagaagccaggtagaagcccctaagctcctgatctatactgcatcctactttgtcaggcggggtcccatccgaaggttccgtggcagtggatcgtgggacagattcactctcaccatcacagtctgacaacctgaacgactgtacgactaaacttactactcgacccaacgtacgtaccttaaccggaaccttcgtaaccttacgttttcggacccgacgggggtaacccagggcctagggaagtaactacgaaaacgtaactggtaacggctacggaccacgactccgttattcc

SEQ ID NO: 354275 - DNA, 585 bp, Homo sapiens
  misc_feature: GZ8MTXP02JHTG2.13.8.A08.1.454.CMB.2.raw
  modified_base (384)..(384): a, c, t, g, unknown or other
  misc_feature (384)..(384): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtcctccatccctccctgtctgcatctggtaggagacagagtcaccgtcacgttggccgggacaagtcagaccattgaacaaatatagtaaattggtatcaacagaagccaggtgaacgcccctaagctcctgatctatactgcatccctatttgtcgagggccggggtcccatccgaaggttccgtgcagtggatcggtgggactagtatttcactctacaccntaccacctagtctgacaacctagaacgaactgtacactaaacttactactcgaccaacgacgttacgtaaccggtaacctacggttactacgtttacgggaccgaacggggacccgagggtcgtacgggaagtaacgtacgaaaaccgtacgtacggtcggtacgttacggactaaacccttacgttaccgttcgtttacc

SEQ ID NO: 354276 - DNA, 588 bp, Homo sapiens
  misc_feature: GZ8MTXP02GGE20.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacttgccgggcaagtcagaccattgacaatatgtaaattggtatcaacagaagccaggtgaacgcccctaagctcctgatctatactgcatccactttgtcaggcggggtccatccaaggtcctggcagtggatcgtgggacagtatttcactctcaccatccacagtctgacacctgaagctgcgactaacttactactagaccctaaacgtacgttaccgttaaccggaacccttcggttaaactaccgtttttacgggacccgtaacgggggtaacccaggggtaccgttaggggaacgtaaacttaccggaaaaaaccgtaaccggttaaggttcgggacctttacggacctaacccgtaagttccctttggtttaaccc

SEQ ID NO: 354277 - DNA, 526 bp, Homo sapiens
  misc_feature: GZ8MTXP02HS75W.13.8.A08.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (400)..(400): a, c, t, g, unknown or other
  misc_feature (400)..(400): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggnaagtcagaccattgaacaaatatgtaaattggtatacaaacagaagccaggtgaaagcccctaaagctcctgatctatactgcatcactttgtcaggcgggtcccatccaaggttccgtggcagtggatctgggacagtatttcactctcaccatcaccagtctagcaaacctgaaacgactgtnactaacttactaactgaccaaacacgtacttaacggaacctcgtactaacgttttcggaccgtaaggggaccaggcgtacggagaactacgaaaacgaactgtaaggctacgcactactcttcgtc

SEQ ID NO: 354278 - DNA, 666 bp, Homo sapiens
  misc_feature: GZ8MTXP02JP6GE.13.8.A08.1.454.CMB.2.raw
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatcgacccagtctccatcctccctgtctgcatctgtagganacagagtcaccgtnacttggccgggcaagtcagacctattgaacaaatatagtaaattggtaatcaacagaagccaggtagaacgcccctaagcctcctgactctatactgcatccctactttgtccgacgggtccggggtaccccagtccccgtaacgggtttcccggtggaccgtaggtcggaacttcggtacgggggaactaggttactttaccgaaccttcctaccaacctattacccacctacggttctcgacctaacccgtagaaacgtcgtaggtacgtaacctaaccttaactacgtacgaaccctaacgtacgttaccgtaaccggtaacccttacgtaaccttaacggtttcggaccgaacgggggtaccacgggtaccgtaggggaactaacgttaccgaaaacggtaaccttgggtaacggccttacggaccgtaacccgttacgttaccgttacgtttacc

SEQ ID NO: 354279 - DNA, 492 bp, Homo sapiens
  misc_feature: GZ8MTXP02G74SR.13.8.A08.1.454.CMB.2.raw
  modified_base (349)..(349): a, c, t, g, unknown or other
  misc_feature (349)..(349): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaaagctcctgatctatactgcatccactttgcaggcggggtccatccaaggttccgtggcagtggatcgtgggacngatttcactctcacatcacagtctgcaacctgaagactgtgacaaacttactactgacctaacagtcttaacggaacctcgtaactactttggcaggggaccaggctggagactcaaaacgactagtgctgcaccatctgttc

SEQ ID NO: 354280 - DNA, 572 bp, Homo sapiens
  misc_feature: GZ8MTXP02GPAD1.13.8.A08.1.454.CMB.2.raw
  modified_base (387)..(387): a, c, t, g, unknown or other
  misc_feature (387)..(387): n is a, c, g, or t
  modified_base (394)..(394): a, c, t, g, unknown or other
  misc_feature (394)..(394): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgaacaaatatagtaaattggtatcaaacagaagccaggtgaagcccctaaagctcctgatctatactgcatccatttgtcaggcggggtcccatccaaggttccgtgcagtgatcgtgggacagatttcactctcacatcacagtctgcaacctgaanactgtanactaacttactactcgaccaaactacgtaccttaacgggaacccttcggtaacctacgttttacggaccgtaacggggggaaccacggggtacgtcgggaaaggtaacttaaccgaaaaaccggtaccgttaggtaacgggcttacggacccaaccgtaacgttcctttacggtttcc

SEQ ID NO: 354281 - DNA, 547 bp, Homo sapiens
  misc_feature: GZ8MTXP02FWK2Q.13.8.A08.1.454.CMB.2.raw
  modified_base (216)..(216): a, c, t, g, unknown or other
  misc_feature (216)..(216): n is a, c, g, or t
  modified_base (332)..(332): a, c, t, g, unknown or other
  misc_feature (332)..(332): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgacaaatatagtaaattggtatcaaacagaagccaggtgaacgcccctaagctcctgatctatactgcatccatttgtcaggcgggtccatccaaggttccgnggcagtggatcgtgggacagtattcactctcaccatcacagtctgcaacctgaacgactgtgactaaacttactactcgacctaaacgagttaccttaacggaaccttacgtaactacgttttcggaccgtaacggggaccaagggccgtgggaacgacttaccgaaaacgtaaccgtagtcgggactacggacacctaacttccgtcgtttacc

SEQ ID NO: 354282 - DNA, 541 bp, Homo sapiens
  misc_feature: GZ8MTXP02IBXS6.13.8.A08.1.454.CMB.2.raw
  modified_base (214)..(214): a, c, t, g, unknown or other
  misc_feature (214)..(214): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacttgccgggnaagtcagaccattgaacaaattatgtaaattggtatacaaacagaagccaggtgaagcccctaagctcctgatctatactgcatccacttttgcagggcggggtccatccgaaggttccgtgcagtggatcgtgggacagtatttcactctcaccatcacagtctgcaacctgaagactgtagactaactttactacttgaccctaacgacgttaccgttaacggtaacccttcggtaacttacgttttacggccgtaacggggaccaggcgtaggacggaactacgaaaacgtaactggaacggctacggcaacctactctgttcc

SEQ ID NO: 354283 - DNA, 610 bp, Homo sapiens
  misc_feature: GZ8MTXP02GYSKK.13.8.A08.1.454.CMB.2.raw
  modified_base (220)..(220): a, c, t, g, unknown or other
  misc_feature (220)..(220): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtccaccgtcacttggccggganaagtcagaccattgaacaaatatagttaaattggtatacaaacagaacgtccgaggtagaacgcccctaaagctcctgactctatactgctactcctactttgcgagggtccggggtacccataccgaacggttccgtggacagtggatcgtaggggacagtactttcactctcacatccacagtctcgacaaccgtagaacgactgtacgtacctaactttactaccttagacctaaacgtacgtaccgttaacgtaacccttcgtaacgttaccgtttcggaccgtaacggggtacccgtaggccggttagggaacgtaaacgtaaccgaaaacgtaacgttacggcgggttaccacggtaccgtaacctactttccggtacgtttcc

SEQ ID NO: 354284 - DNA, 581 bp, Homo sapiens
  misc_feature: GZ8MTXP02JFECP.13.8.A08.1.454.CMB.2.raw
  modified_base (215)..(215): a, c, t, g, unknown or other
  misc_feature (215)..(215): n is a, c, g, or t
  modified_base (279)..(279): a, c, t, g, unknown or other
  misc_feature (279)..(279): n is a, c, g, or t
  modified_base (337)..(337): a, c, t, g, unknown or other
  misc_feature (337)..(337): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacgttgccgggnaagtcagaccattgacaaatatagtaaattggtatcaacagagccaggtgacgccctaagctcngatctatactgcactcctactttgtcgagggtccgggtccctatccgaaggttcccgngcaggtggatcgtgggacagtactttcactctacaccatcgaccagtctgacaacctagaagactgcgactaacttactactcgacccaactacgttaccttaaccggaaccttcgtaaccttacgtttacggacccgtaacggggaccgaacggtcgtacgggaacgaaacgttaccgaaaaaccggtcgttacgggtcgtaccgttacggtacccaaccgtaacgttcctttcggtttaccc

SEQ ID NO: 354285 - DNA, 733 bp, Homo sapiens
  misc_feature: GZ8MTXP02HC5G0.13.8.A08.1.454.CMB.2.raw
  modified_base (287)..(287): a, c, t, g, unknown or other
  misc_feature (287)..(287): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcaagaacattggactaacttctttaaattggtatcagcagaagtcaggcaacgccccgaacctccngactctacggtacatcctatttgcacgtagtggactccatacgaaggttcagtggacagtagatcgtaggaaacagttactttacccacacctatacgtacggggtacctaacgacgtacccgtagtaaacgttagtttttacggaaccggttaaccttttaccgttaaagtttaccgttaaccgtaaaaccgtaacggtttaaccgttttaaccccgtttaccccggttaacccccccgggtaccggtttacccgggttaaaccccgggaaaccgggggtaaacccggttaaaacggggtaaacgggtaaaacgttaaaccggtaaaacggtaaaccggtaaccggtaaggttacgggtacgttaccgggaccgtaaccccgtaattccgttacggttaccctttacttaaaccttccccggtttacccccgtacctttaacccg

SEQ ID NO: 354286 - DNA, 509 bp, Homo sapiens
  misc_feature: GZ8MTXP02I1FCQ.13.8.A08.1.454.CMB.2.raw
  modified_base (475)..(475): a, c, t, g, unknown or other
  misc_feature (475)..(475): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacttgccgggcaagtcagaccattgacaaatatgtaaattggatcaacagaagccaggtgaagcccctaagctcctgatctatactgcatcccgtatttgtcaggcggggtccatccaaggttcctggcagtcggatcgtgggactagtatttcgactctcacatcaccagtctgcaacctgaacgactagtcactaaacttactacttgaccaactacgtaccttacggaaccttcgtactacgtttggacgtagggaccaggcgtcgganacgtacaaacgaactgtgctcgcacactctcttc

SEQ ID NO: 354287 - DNA, 629 bp, Homo sapiens
  misc_feature: GZ8MTXP02HZLYP.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttggccgggacaagtcagaccattgaacaaatatgtaaattggatacaacagaagccaggtgaacgcccctaagctcctgatctatactgactactcctatttgcgagggccggggtacccatccgaaggttccgtggctaggtggatcgtgggactagtacttcactctaccaccatccacctagtctgacctaaccgtagaacgtactggtacacctaaactttactacgttacgaccctaacgtacgttaccgttaacccgggaaccttcggttaacctttaccggttttacgggaccccggtaacgggggtaacccaggggtacccgttaggggaacgtaaccgttaccgaaaaaccggtaccgttgggtaaccgggtcttacggaccctaacccttacgtttccgttacggtttccc

SEQ ID NO: 354288 - DNA, 555 bp, Homo sapiens
  misc_feature: GZ8MTXP02JQAKX.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtccatccgaaggttccgtggcagtggatcgtgggacagtatttcactctcaccatcaccagtctgacaacctgaaacgactgtacactaaacttactactcgacctaactacgttaccttaaccggaacccttcggttaacctacgttttcggaccgtaacgggggacccagggccgtaggaagtactacgaaaacgtaaccgttggaacggcttacggacctacctactcctagtttccc

SEQ ID NO: 354289 - DNA, 598 bp, Homo sapiens
  misc_feature: GZ8MTXP02IBT5O.13.8.A08.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggnaagtcagaccattgaacaaatatagtaaattggtatcaaacagaagccaggtgaacgcccctaagcctcctgatctatactgcatccacttttgcagggccgggtcccatccgaaggttccgtggcagtggatcgtgggacagtatttcactctccacctacacacctagtctcgacaaccgtagaacgactgtacgaccttaaacttaccttaactcgacctaacgtacgttaccgttaaccggtaaacccttacgttaaccgttaccgttttcggaccgtaacggggtaccgaacgggtccgttaaggacggtaactaaccgtaaaacggtaaccgtggtaacgggtctacggacctaccgtaacgttcctttacgttccc

SEQ ID NO: 354290 - DNA, 535 bp, Homo sapiens
  misc_feature: GZ8MTXP02IP95P.13.8.A08.1.454.CMB.2.raw
  modified_base (285)..(285): a, c, t, g, unknown or other
  misc_feature (285)..(285): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgaacaaatatagtaaattggtatcaaacagaagccaggtgaagcccctaagctccngatctatactgcatccctatttgcgagggccggggtacccagtacccgaaggttccgtgcagtggatcgtgggacagtatttcactctcaccataccacagtctgacaacctagaagacgtgtcgactaacttactactcgaccaacacgtacttacggaacctcgtactacgttttcggaccgtacgggaccgaggtcgtcggaagactacgaaaacgacgtagtggctagcaccacgttctcgttacc

SEQ ID NO: 354291 - DNA, 634 bp, Homo sapiens
  misc_feature: GZ8MTXP02HJKI1.13.8.A08.1.454.CMB.2.raw
  modified_base (220)..(220): a, c, t, g, unknown or other
  misc_feature (220)..(220): n is a, c, g, or t
  modified_base (265)..(265): a, c, t, g, unknown or other
  misc_feature (265)..(265): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctggtaggagacaggagtccaccgtcacttggccggganaagtcagacctattgaactaaatatagtaaattggtataccaaanagaacgtcgaggtagaaccgtcccctaagctccngtactctaatacngactactaccttacgtttgcggacgggtcccggggtccaagtccgtaaacggttccgtggactaggttcggattcggtgggtaacagttactttccgactcctactaacactaccaccgacgtctcgtacctaaccgtagtaacgactcgtacgaaccttaaacttaactaaccttacgaccctaaacgtaacgttaccgttaaaccgtaacccgttacgttaaccttacgtttacggccgtaacgggtaccgacggccgtaggaagtaactacgtaaaaccgtacgtaggtcgtacgcgtacactactacgtttcttaccg

SEQ ID NO: 354292 - DNA, 674 bp, Homo sapiens
  misc_feature: GZ8MTXP02FSI7W.13.8.A08.1.454.CMB.2.raw
  modified_base (191)..(191): a, c, t, g, unknown or other
  misc_feature (191)..(191): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttggccgggcaagtcagaccattgaacaaatatagtaaattggtatacaaacagaagccgaggtacgaaacgtacccctaaagccttacctagactctaatactgactactccctacgtttcggtcgacggggtccggggtaccccagttacccgtaacgggttccgtggaccgtaggttcggaacttccggtaggggaacctaaggttacttttaccaaccttccttacccaaaccctattacccaaccgtaacggttccttacgaaccctaaacccgttaggaaacgtaccgtagtacgtaaccttaaacctttacctaacgtacgtaacctaaacgtacgttacccgttaacggtaacccttcggttaaccttcgtttacgggaccgaacggggtaccagggtctaggaacgaactaaccgaaaacgtcttaggcgtactacgacctacctatccgtttctacc

SEQ ID NO: 354293 - DNA, 517 bp, Homo sapiens
  misc_feature: GZ8MTXP02FOLH8.13.8.A08.1.454.CMB.2.raw
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacttgccgggcaagtcagaccattgacaaatatagtaaattggtatcaacagaagccaggtgaagcccctaagctcctgatctatactgcatccactttgcaggcgggtccatccaaggttccgtgcagtgatcgtgggacagtatttcactctcacatcacagtctgacaacctgaagactgtagactaaacttactactcgaccaactagtaccttaacggaacctcgttaactacgtttggaccgtaaggggaccagggctaggaagactacgaaaacgtactaggtcgactcgacacctatcctagttcc

SEQ ID NO: 354294 - DNA, 644 bp, Homo sapiens
  misc_feature: GZ8MTXP02IW06T.13.8.A08.1.454.CMB.2.raw
  modified_base (261)..(261): a, c, t, g, unknown or other
  misc_feature (261)..(261): n is a, c, g, or t
  modified_base (292)..(292): a, c, t, g, unknown or other
  misc_feature (292)..(292): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtccaccgtctacgttggccgggacaagtcacgacctattgaactaaatatagtaaattggtatanaacagaagccaggtgaacgccctaagctccngactctatactgcactcctacgtttgtcgacgggccggggtaccctagtacccgtaacgggttcccgtggcgtaggtggatcggtgggacagtactttcgactctcactatcacagtctgactacctagaacgtacctagtacgtactaaacctttactaccgttacgaccctaacgttaccgttaccgttaaaccggtaacccttacgttaaaccttacggttttacggacccgggtaaacggggaaaccgtcggtacggttaaacgggaacggttaaacgtaaccgtaaaaacggccgtttacggaacgggtcctaacggtaccgaactaccgtttcgttacggtttccc

SEQ ID NO: 354295 - DNA, 595 bp, Homo sapiens
  misc_feature: GZ8MTXP02HB0XG.13.8.A08.1.454.CMB.2.raw
  modified_base (338)..(338): a, c, t, g, unknown or other
  misc_feature (338)..(338): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccgtcacttgccgggcaagtcagaccattgaacaaatatgtaaattggtatcaaacagaagccaggtagaagcccctaaagctcctgatctatactgcatccactttgtcaggcggggtcccatccgaaggttccgnggcagtggatcgtgggacagtatttcactctcaccatcacagtctgacaacctgaaacgactgtcactaaacttactactgaccaaactacgtaccgttaaccggaacccttacgtaacttaccgttttacggggacccgtaacgggggtaaccacggggtaccgttacggggaaggaaacttaaccgaaaaacggtaaccgttaggttaacgggccttacggaccctaaccgtaacgtttcccttaggttttcccc

SEQ ID NO: 354296 - DNA, 557 bp, Homo sapiens
  misc_feature: GZ8MTXP02JO24E.13.8.A08.1.454.CMB.2.raw
  modified_base (330)..(330): a, c, t, g, unknown or other
  misc_feature (330)..(330): n is a, c, g, or t
  modified_base (350)..(350): a, c, t, g, unknown or other
  misc_feature (350)..(350): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaaacagaagccaggtgaagcccctaaagctcctgatctaatactgcatccactttgcaggcggtccatccaaggttccgnggcaggtgatcgtagggacngtactttcactctcaccatcaccagtctcgacaacctagaaagtactgtacgactaaacctttactaactcgaccaaacgtacgttaccgttaacggaaccttacgtaaccttacgtttcggaccgtaaacggggtacccagggcctagggaacgactaaccgaaaacgtaactaggtcggactacgacaacctacttctcgttacc

SEQ ID NO: 354297 - DNA, 608 bp, Homo sapiens
  misc_feature: GZ8MTXP02JDT6P.13.8.A08.1.454.CMB.2.raw
  modified_base (189)..(189): a, c, t, g, unknown or other
  misc_feature (189)..(189): n is a, c, g, or t
  modified_base (282)..(282): a, c, t, g, unknown or other
  misc_feature (282)..(282): n is a, c, g, or t
  modified_base (421)..(421): a, c, t, g, unknown or other
  misc_feature (421)..(421): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccgtcacttggccggcaagtcagaccattgacaaatatgtaaattggtatcaaacagaagccaggtgaacgcccctaagctccngatctatactgcatccatttgcaggcggtccatcgaagttccgtgcagtggatcgtgggactagatttcactctcaccatcgaccagtctgacaacccgtagaaacgtactgtacgacctaaacctttaactaaccttnacccaaacgtacgttaccttaacccgggaaacccttacggttaaaccttaccgttttacgggacccgaaacgggggtaccccaaggggtcccgttacgggaaagaacgttaaccgaaaaaccggtaaaccgtttggtaacgggacctttacggaccctaccgtaaactttcccggtttacgtttacc

SEQ ID NO: 354298 - DNA, 580 bp, Homo sapiens
  misc_feature: GZ8MTXP02GOOAT.13.8.A08.1.454.CMB.2.raw
  modified_base (406)..(406): a, c, t, g, unknown or other
  misc_feature (406)..(406): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtccaccgtcacttgccgggcaagtcagaccattgaacaaatatagtaaattggtatcaacagaagccaggtagaacgcccctaagctcctgatctatactgcactcctacgtttgcgagggccgggtaccagtcccgtaaggttccgtggcaggtggatcgtgggacagtatttcactctacacatccacagtctgacaacctagaacnctgtacgactaaacttactactgaccaacgtacgttaccttaaccggaaccttacggtaaccttcgtttacgggaccgtaacgggggaccagggtacgtacggggtaacaacgttaaccgaaaaccgtacgttaggtcggactacggacctaaccgtacttcgttacgtttccc

SEQ ID NO: 354299 - DNA, 672 bp, Homo sapiens
  misc_feature: GZ8MTXP02H2BM9.13.8.A08.1.454.CMB.2.raw
  modified_base (238)..(238): a, c, t, g, unknown or other
  misc_feature (238)..(238): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacttgccgggcaagtcagaccattgaacaaatntagtaaattggtatcaacagaagcaggtgaacgcccctaagctcctagatactatactgcactcctacttttgcgagggtccggggtaccctagtacccgtaacggggtttcccggtagggccgtagggtggtaacttccggttagggggaactacggttacttttaccaaccttcctacccaaccctactaccgaaccctaaggtccttacggaccctaaacccgttaggaaaacgtaccgttagtacgtaaccttaaactttaacctacttacgaaccctaaacgtacgttaccgttaaccggtaaccctttacgtaacttacgtttacgggaccgtaacgggggaccgtagggccgttagggaacgtaactaaccgaaaacgtaacgttacggtcggacctacggacctaccgtacgtttcttacgtttcc

SEQ ID NO: 354300 - DNA, 608 bp, Homo sapiens
  misc_feature: GZ8MTXP02G1JWE.13.8.A08.1.454.CMB.2.raw
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtnacttgccgggnaagtcagaccattgaacaaatatagtaaattggtatcaaacagaagccaggtgaacgcccctaagctcctgatctatactgcatccatttgcgagggtccgggtcccagtccgtaacgggttccgtggcaggtggatcgtgggacagtattcactctcaccatccacagtctgacaacctgaagtactgtacgacctaaacttactactcgacctaaacgtacgttaccttaacggtaacccttacgttaaccttacgttttacgggacccgtaaacgggggtacccaagggtaccggttacgggaaacgtaacgttaaaccgaaaaaccggtaaaccgttgggtaacgggtacctacggacctaacccgtaagttccttacgtttaccccg

SEQ ID NO: 354301 - DNA, 551 bp, Homo sapiens
  misc_feature: GZ8MTXP02F2XEK.13.8.A08.1.454.CMB.2.raw
  modified_base (204)..(204): a, c, t, g, unknown or other
  misc_feature (204)..(204): n is a, c, g, or t
  modified_base (335)..(335): a, c, t, g, unknown or other
  misc_feature (335)..(335): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtnacttgccgggcaagtcagaccattgacaaatatgtaaattggtatcaaacagaagccaggtgaacgcccctaagctcctgaatctatactgcatccactttgtcagggcggggtcccatccaaggttccgnggcagtggatcgtgggactagatttcactctaccacatccaccagtctgaccaacctgaacgactgtacgactaaacttactactacgacccaaacgtacgtaccttaacggaacccttacgttaactaccgttttcggaccgtaacggggacccagggaccgtcgggaatacgtacgaaaacgactaggtaacgctacgccaacctctactcgtc

SEQ ID NO: 354302 - DNA, 633 bp, Homo sapiens
  misc_feature: GZ8MTXP02JRCVZ.13.8.A08.1.454.CMB.2.raw
  modified_base (189)..(189): a, c, t, g, unknown or other
  misc_feature (189)..(189): n is a, c, g, or t
  modified_base (293)..(293): a, c, t, g, unknown or other
  misc_feature (293)..(293): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctcctgtctgcatctgtagganacagatccaccgtcacgttggccggacaagtcagacattagaacaatatagtaaattggtatacaaacgagaagccgaaggtcgaaacgacccctaagccttcngtatctatactgctactcctatttgacgagggtccgggtacccagtaccgtaacgggttccgtggacgtaggtggtactcggtagggaactagtactttcgaacttctacacctactaccactacgtctacgacaaccgtagaaacgtctagtacgacctaaacctttacaacgtcgaacctaaacgtacgttacctaaccggtaacctacgttaaacttccgtttacggacccgtaagggtacccgacgggtacgtacgggaaacgttactaaacgaaaacggtaccgtaggtaacggtacctacggtacccaaaccgttcttaccgttctttaacccg

SEQ ID NO: 354303 - DNA, 566 bp, Homo sapiens
  misc_feature: GZ8MTXP02H6EYH.13.8.A08.1.454.CMB.2.raw
  modified_base (214)..(214): a, c, t, g, unknown or other
  misc_feature (214)..(214): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcacgtcacttgccgggnaagtcagacattgaacaaatatgtaaattggtatacaaacagaagccaggtgaacgcccctaagctacctgatcatactgactatcctactttgcgaaggggtccggggtacccagtccgaaacgggtttcccgtgggctaggtgggaattccgtgggggaacaggttactttcactctacaacccatccaaccagtccagtacaaaccgttgaaacgtacgtgtagactaaactttacacttgacccaatacgttaccttaacggaaccttcggtaactacgtttgaccgagggacaggtcgtagaggtactacgaaacgtactggtaagctacgaccacacttctacttc

SEQ ID NO: 354304 - DNA, 604 bp, Homo sapiens
  misc_feature: GZ8MTXP02GPO1M.13.8.A08.1.454.CMB.2.raw
  modified_base (215)..(215): a, c, t, g, unknown or other
  misc_feature (215)..(215): n is a, c, g, or t
  modified_base (343)..(343): a, c, t, g, unknown or other
  misc_feature (343)..(343): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacttgccgggnaagtcagaccattgaacaaatatagtaaattggtatacaaacagaagcctaggtagaacgcccctaaagctcctgatctatactgctatcctactttgtcaggccggggtaccatccgaaggttccgnggcaggtggatcgtggggactagactttcaactctcaccatcacagtctgacaaccgtagaaagtaccgtgtacacctaaatttaacctactcgaccctaaacgtacgttaccgttaaaccggtaacccttcgtaaccgtacgtttttacgggaccggtaacgggggaaccgtacgggacttacggggaagtacgttaccgaaaaacggtacccttaaggggtcgacggttacaccggaacctaacttcgttacgtttccc

SEQ ID NO: 354305 - DNA, 607 bp, Homo sapiens
  misc_feature: GZ8MTXP02HHIA3.13.8.A08.1.454.CMB.2.raw
  modified_base (351)..(351): a, c, t, g, unknown or other
  misc_feature (351)..(351): n is a, c, g, or t
  modified_base (366)..(366): a, c, t, g, unknown or other
  misc_feature (366)..(366): n is a, c, g, or t
  modified_base (427)..(427): a, c, t, g, unknown or other
  misc_feature (427)..(427): n is a, c, g, or t
tcagtcacgtactacacgaccggtgctcgatttagcatactctacagggggggagtcagtctcagtcaggacacagcatggacatgggggtccccgctcagctcctggggctcctgctactctggctccgaggtgccagatgtgacatccagatgacccagtctccatcctccctgtctgcatctgtaggagacagagtcaccgtcacttgccgggcaagtcagaccattgaacaaatatagtaaaattggtaatcaaacaagaagccaggtagaacgccccctaagcctcctgattactatactgcactcctacttttgcagggccggggtcccagtcgaacggttccgnggcaggtggattcgnggggacagtactttcactctaccaccatccaacctgtctgaccaacgtgaacgactggtanaaccttaaacgttaccttactcgaaccctaaactacggttaccttaaaccggtaaccttaccggtaactttaccggtttcgggacccgtaaagggggacccctaggggtccttaggggaacgtaacttaccgaaaacgtaccgtggtacggctacgcctaccattccgttctactttccg

SEQ ID NO: 354306 - DNA, 590 bp, Homo sapiens
  misc_feature: GZ8MTXP02JFJT9.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttcggccgggacaagtcagaccattgaacaatatagtaattgtatacaacagagccaggtagaacgcccctaagctccagactctatactgcatccctatttgtcgagggtccggggtcctatacccgtaacgggttccgtggacgtaggtggacttcggtagggactagttattccacttctaccacctatccaacccgagtctcgaccacccgtagaagtcctgtacgacctaaactttacgtactcgaacctaacgtacgtaccgttaaccgacctcgttacgttaccgtttcggaccgaacgggggacacggttccggtaggaacgttacgacgaaaacgtacgtgtcggtactcggaccaccagttccttaacgttcc

SEQ ID NO: 354307 - DNA, 640 bp, Homo sapiens
  misc_feature: GZ8MTXP02IC69W.13.8.A08.1.454.CMB.2.raw
  modified_base (217)..(217): a, c, t, g, unknown or other
  misc_feature (217)..(217): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaccgtcacttgccgggnaagtcagaccattgaacaatatagtaaattggatacaacagaagccaggtagaacgcccctaagcctcctagatctatactgctatccactttgcgaggggccggggtccagtccgtaacgggttccgtaggactaggtggacttcggtacggggtaacaggttactttccacttctaccacctatccacccgtagtcctacgaccaacccgttagtaaacgtacgttcgtacgaccttaaacctttacctaacgttacgaaccctaaacgtacgttaccgttaaccggtacccttacgttaacccgttacgttttacgggaccgtaacgggggtacctagggtaccgtagggaacgtaaacgttacgaaaaccgtaacgtaggtaacggtactacggacctaccgtacttcgttactttccc

SEQ ID NO: 354308 - DNA, 652 bp, Homo sapiens
  misc_feature: GZ8MTXP02JGQS7.13.8.A08.1.454.CMB.2.raw
  modified_base (193)..(193): a, c, t, g, unknown or other
  misc_feature (193)..(193): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtcctccatcctccctgtctgcatctgtagganacagagtccaccgtcacgttggccgggacaagtcacgacctattagaactaaatatagttaaattggtatacaacagaagccaggtgaacgcccctaagctcctgatctaatactgactactcctactttgcgacgggtccggggtaccagtaccgtaacgggttccgtggactaggtggacttcggtggggaactaggtacttcactctacctaaccactaccaccagtctacgacctaaccgtagaacgtacgtgtacgtaactaaaccttaactactacgaaccctaaacgtacgttaccgttaaaccgtaacccttacgttaaccgttaccgttttacgggaccggtaacggggtaaccggtacggtaccgtagggaacgtaacgtaaaccgtaaaaccggtaaccgtggtaacggtcgttacggacctaaccgtacttccgttacgtttccccg

SEQ ID NO: 354309 - DNA, 686 bp, Homo sapiens
  misc_feature: GZ8MTXP02JGCDS.13.8.A08.1.454.CMB.2.raw
  modified_base (190)..(190): a, c, t, g, unknown or other
  misc_feature (190)..(190): n is a, c, g, or t
  modified_base (265)..(265): a, c, t, g, unknown or other
  misc_feature (265)..(265): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtagganacagatcaccgtcacttgccgggcaagtcagaccattgaacaatatagtaaattggtatcaacagaagccaggtnaacgcccctaagcctcctgactctatactgcatccctatttgccaggggccggggtaccccagtcccgtaaacggggtttcccgtgggacctaggtgggattccggtgggggaaacctaggttactttaccaactttcctaccaaccctactaccctaacccacgtcctacggacctaaacccgttaggaaacgtacgttacgtcgtaaccttaaacctttaaaccgtaccttaccgaccctaaaccgtaaccgttacccgtttaaccggtaacccgttaccggttaaccttaaccgtttttacgggaacccggtaacgggggacccgtaacgggtccggttaagggaacgtaacgttaaccgaaaaccggtaacgttacggtcggacgtacggtaccaccgtaacttcgttacgtttccc

SEQ ID NO: 354310 - DNA, 709 bp, Homo sapiens
  misc_feature: GZ8MTXP02GFZM6.13.8.A08.1.454.CMB.2.raw
  modified_base (216)..(216): a, c, t, g, unknown or other
  misc_feature (216)..(216): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgaacaatatagtaaatggtatcaacagaagccaggtagaacgacccctaagctcctgtatctatactgacactccactttgcgtacggcggggtccctatacccgtaaggttcccgtgggcctaaggtggtatcggtagggactaaggtatttaccactcctacccaccctacttacccaaccgacgttaccttacgaccaaaccccgttagtaaacgtacgtacgggtacgtaaccctaaaccgtttaactaaccttaccggtaacccctaaaccgttaacgttaacccgtttaaacccgggtaaacccgttaaccgtttaaaccgtaccggtttttaccgggaccccggttaacgggggaacccggtaacgggttacccgtaaggggtaacgtaaacgttaaccgaaaaacccggtaaccgtagggttaacggaccgttacggaccgtaaccgtaaacgttaccttcggtttaacccg

SEQ ID NO: 354311 - DNA, 665 bp, Homo sapiens
  misc_feature: GZ8MTXP02JFHC8.13.8.A08.1.454.CMB.2.raw
  modified_base (216)..(216): a, c, t, g, unknown or other
  misc_feature (216)..(216): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgaacaaatatagtaaattggtaatcaaacagaagccgaggtcgaacgcccctaagctcctgatctatactgctatccctatttgtacgagggtccggggtaccccagtcccgtaaacgggtttcccgtggacgtaggttcggaacttccggtaggggaacctaaggttaactttttccaacctttccttacccaaacccgtattaccccaacctaacggttccttacggaaccctaaacccgttaggaaacggtaccttaggtacggtaaaccttaaactttaacctaaccttacggaacccctaaactacggttacccttaaccgggaaccttacggttacttaccgttttcgggacccgtacgggggaccaggtaccgtagggaacaactacgaaaacgtacttggaagcacgaccaacctacgttcgtcttac

SEQ ID NO: 354312 - DNA, 589 bp, Homo sapiens
  misc_feature: GZ8MTXP02FNDFX.13.8.A08.1.454.CMB.2.raw
  modified_base (217)..(217): a, c, t, g, unknown or other
  misc_feature (217)..(217): n is a, c, g, or t
  modified_base (338)..(338): a, c, t, g, unknown or other
  misc_feature (338)..(338): n is a, c, g, or t
  modified_base (351)..(351): a, c, t, g, unknown or other
  misc_feature (351)..(351): n is a, c, g, or t
  modified_base (357)..(357): a, c, t, g, unknown or other
  misc_feature (357)..(357): n is a, c, g, or t
  modified_base (400)..(400): a, c, t, g, unknown or other
  misc_feature (400)..(400): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccgtcacttgccgggnaagtcagaccattgaacaaatatgtaaattggtatcaacagaagccaggtgaacgcccctaagcctcctgatctatactgcatcccactttgtcgaggcggggtcccatccaaggttccgnggcagtggatcgngggacngtatttcactctcaccatcacagtctgcaacctgaaacgctgngactaaacttactactgacccaaatacgtaccttaaccggaacccttcgtaactacgttttacgggacccgtaacgggggtaacccgagggtaccgttagggaacgtaaacgtaaccgaaaaaccggtaaccgtttggtaacggggccttacgggacccaaacccgtattaccgttacggttttacccc

SEQ ID NO: 354313 - DNA, 536 bp, Homo sapiens
  misc_feature: GZ8MTXP02IEX6Y.13.8.A08.1.454.CMB.2.raw
  modified_base (216)..(216): a, c, t, g, unknown or other
  misc_feature (216)..(216): n is a, c, g, or t
  modified_base (392)..(392): a, c, t, g, unknown or other
  misc_feature (392)..(392): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgaacaaatatgtaaattggtatcaacagaagccaggtgaaagcccctaagctcctgatctatactgcatccactttgcaggcggggtccatccaaggttccgtgcagtgatcgtgggacagatttcactctcacctatcacagtctgacacctgaagactgtnactaaactttactaacttcgacccaaactacgttaccgtaaacggtaaccttcgtaacttacgttttcggaccgtacggggaaccaggccgtaggagaactacgaaaacgtaactggtcggctacggacacctatctagtttcc

SEQ ID NO: 354314 - DNA, 618 bp, Homo sapiens
  misc_feature: GZ8MTXP02J0GWJ.13.8.A08.1.454.CMB.2.raw
  modified_base (266)..(266): a, c, t, g, unknown or other
  misc_feature (266)..(266): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagaatgacccagtctccatcctccctgtctgcatctgtaggagacagagtcaccgtcacttgccggcaagtcagaccattgacaaatatgtaaattggtatcaaacagaagccaggtnaacgcccctaagcctacctgaactctatacctgacactcctatttgtcacgggtccggggttccccataccccgaaaggtttccgtaggcaggtggacttccgtaggggacctaggtatttccaacttcctacaccctaatccaactacgtacctgaccaaaccctaggaacgtacgtagtagacctaaacttactacttacgaccaaactacgtacttaaccggtaactccgtaactacgtttacgaccgacgggtaccgaggcgtaggaacgtacgttaaccgaaaaccgtaaccgttaggtaacggtccttacggacccgtaaacccttacgtaccgtttacgttaccg

SEQ ID NO: 354315 - DNA, 518 bp, Homo sapiens
  misc_feature: GZ8MTXP02GPR8Q.13.8.A08.1.454.CMB.2.raw
  modified_base (216)..(216): a, c, t, g, unknown or other
  misc_feature (216)..(216): n is a, c, g, or t
  modified_base (497)..(497): a, c, t, g, unknown or other
  misc_feature (497)..(497): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgaacaaatatgtaaattggtatcaacagaagccaggtgaagcccctaagctcctgatctatactgcatccactttgtcaggcgggtcccatccaaggttccgtggcagtggatcgtgggacagtatttcactctcacatacacagtctgacaacctgaagactgtgactaacttactactgaccaaactagtaccgttacggaacctcgtaactacgttttacggaccgtacggggaccaggctaggaacgactacaaaacgactagnggctgacacactcgtcttacc

SEQ ID NO: 354316 - DNA, 751 bp, Homo sapiens
  misc_feature: GZ8MTXP02IKH1B.13.8.A08.1.454.CMB.2.raw
  modified_base (292)..(292): a, c, t, g, unknown or other
  misc_feature (292)..(292): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctggtaggagacagacgtcaccgtcacgttggccgggcaagtcagacctattgaacaatatagtaaattggtatcaaacagaagccaaggtgaacgacccctaagctccngatctatactgcactcctactttgtcgacggggtccggggtacccagttacccgtaaacggggtttccgtacgggctagggttcgggtaattcccggggtaggggtaaccgtaaggtttacctttttacccggaaccgttccgttaaccctaacccctaaacttccccgaaaccctaacgggttcccttccggaaaccctaaacccccgtttaaggaaaacgggtaaccttcgggttaccgtaaccttaaaaccccttttaaaccgttaacctttaccggaaccccttaaacgtaaacccgttaccgtttaaacccggggaaccctttacgttaaaccgttaacgtttttacgggacccgaacgggggttacccgaaacggcggttaccgggaagtaacgttacgaaaaacgtccgtaggtaaggtccttacggacctaaccacgtttctcggtttacc

SEQ ID NO: 354317 - DNA, 514 bp, Homo sapiens
  misc_feature: GZ8MTXP02FG88K.13.8.A08.1.454.CMB.2.raw
  modified_base (216)..(216): a, c, t, g, unknown or other
  misc_feature (216)..(216): n is a, c, g, or t
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
  modified_base (416)..(416): a, c, t, g, unknown or other
  misc_feature (416)..(416): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgacaatatgtaaatggtatcaacagaagccaggtgaagcccctaagctctgatctatactgcatccactttgtcaggcggggtccccatccaaggttccgnggcagtggatcnggggacagtatttcactctcaccatcaccagtctgacaacctgaagactgtgactaacttactactgccaaacngtccttacggaacctcgtacactttacggccgtaaggggaccaggctaggaagactaaccgaaaacgaactggtaacgctacgccacctatctgttcc

SEQ ID NO: 354318 - DNA, 596 bp, Homo sapiens
  misc_feature: GZ8MTXP02F6ZIY.13.8.A08.1.454.CMB.2.raw
  modified_base (550)..(550): a, c, t, g, unknown or other
  misc_feature (550)..(550): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatccctcctgtctgcatctgtaggagacagagtcaccgtcacttggccggcaagtcagaccattgaacaaatatagtaattgtatacaacagaagccaggtagacgacccctaagctcctgatactatactcgactactcctactttggtccgaggggtcccggggtcccagttacccgtaacgggtttccccgtaggcgtaaggttggaacttcgggtacggggactaagttactttccaaccttccactacccattcccaacctagttcacgacaaccctagaaacgcttgtagacctaaaccttaactacgtcacctaaaacgtcgttaacgtacggaaccttcgtaactcgtttcgaccggcgggtaccaggtcgtagganactaacgaaaacgacttgcggactgacccacgtcttactcgtttcc

SEQ ID NO: 354319 - DNA, 640 bp, Homo sapiens
  misc_feature: GZ8MTXP02I16YZ.13.8.A08.1.454.CMB.2.raw
  modified_base (193)..(193): a, c, t, g, unknown or other
  misc_feature (193)..(193): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtctccatcctccctgtctgcatctggtagganacagagtccaccgtcacttggccgggacaagtcagaccattgaacaaatatagtaaattggtatacaaacagacgcaggtagaacgtcccctaagctcctgatctatactgcactccctatttgtccgaggggtccggggtccctagtaccgtaacgggttcggtggacgtaggtggatcgtacggggactaaggtacttttccaactttctacccaaccctacttacccgaccctaacgttcttacgaacccctaacctaagtaacggtaacttcgggtactaacccttaaactttaacctaaccttacgacccctaagtaacgttacccgttaacggtaacccttacgttacctacgtttacggaccgtacgggacgacggcgtaggtaacgactaacgaaaccgtagtacggtgtcgtacgacctaacctctacttacgtttcc

SEQ ID NO: 354320 - DNA, 610 bp, Homo sapiens
  misc_feature: GZ8MTXP02IVC7Q.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtccaccgtcacttgccgggcaagtcagaccattgaacaaatatagtaaattggtatacaacagaagccgaggtagaacgacccctaagctcctgatctaatactgacacttcctactttgcgagggtccggggtacccagtaccgtaacggttccgtggcgtaggtggatcggtagggacagtatttcactctacacctatccacagtctagacctaaccgtagaacgtactgtacactaaacctttacaacgttcgaaccctaaacgtaccgttaccgttaaccgaaccttaccgttaaactcgttttacggaccgtaacggggtaccgaggtccggtaggtaaacgtaactaacgtaaaacgtaacgttcgtaaggtaccacgtacgaacccttagttccgttacgtttcc

SEQ ID NO: 354321 - DNA, 561 bp, Homo sapiens
  misc_feature: GZ8MTXP02JS9W9.13.8.A08.1.454.CMB.2.raw
  modified_base (215)..(215): a, c, t, g, unknown or other
  misc_feature (215)..(215): n is a, c, g, or t
  modified_base (299)..(299): a, c, t, g, unknown or other
  misc_feature (299)..(299): n is a, c, g, or t
  modified_base (341)..(341): a, c, t, g, unknown or other
  misc_feature (341)..(341): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccggnaagtcagaccattgaacaaatatagttaaattggtatcaaacagaagccaaggtgaacgcccctaagctcctgactctatactncatcccatttgtcaggccgggtcccagtcccgaaggttccgnggcaggtggatcgtgggactagtatttcactctcaccatccaccagtctgaccaacctgaagtactgtcgactaacttactactacgaccaacgtacgttaccgttaaccggtaaccttacgtacttacgttttacggaccgtacggggtaccaggtaccgtggacgtaactaccgaaacgaacttggtaacggctacggaccactactcgtacgtttcc

SEQ ID NO: 354322 - DNA, 578 bp, Homo sapiens
  misc_feature: GZ8MTXP02IQA40.13.8.A08.1.454.CMB.2.raw
  modified_base (204)..(204): a, c, t, g, unknown or other
  misc_feature (204)..(204): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtnacttgccgggcaagtcagaccattgacaaatatgtaaattggtatcaaacagaagccaggtgaagcccctaagctcctgatctatactgctatccctatttgtcgaggtccggggtcccagtcccgaaggttcccgtggctaggtggatcgtggggactagtatttcacttctaccaccataccaccagtctgacaacctgaacgactgtacgactaacttactactagacccaactacgttaccttaccggaacccttcgtacctaccgttttacggaccgaacgggggtacccagggccgtaggggaactaacgtacaaaacggtaacgtcgtaagggtcctacggacctacctacgttacttcggtttacc

SEQ ID NO: 354323 - DNA, 568 bp, Homo sapiens
  misc_feature: GZ8MTXP02INVN9.13.8.A08.1.454.CMB.2.raw
  modified_base (216)..(216): a, c, t, g, unknown or other
  misc_feature (216)..(216): n is a, c, g, or t
  modified_base (332)..(332): a, c, t, g, unknown or other
  misc_feature (332)..(332): n is a, c, g, or t
  modified_base (399)..(399): a, c, t, g, unknown or other
  misc_feature (399)..(399): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgaacaaatatgtaaattggtatcaaacagaagccaggtgaagcccctaagctcctgatctatactgcatccactttgtcaggcgggtccatccgaagttccgngcagtggatcgtgggacagatttcactctcaccatccacacgtctcgacaaccctgaaagactgtanacaaacctttaactaccttcgaccaaactaacgttaccgttaacggaaaccttacgtaacttacgttttacggaccgtaacggggaccgaacgggccgtacggaaggaacttaccgaaaaccgtaaacgtggtaacgggcttacgacctaaccattccgttcgtttacc

SEQ ID NO: 354324 - DNA, 536 bp, Homo sapiens
  misc_feature: GZ8MTXP02JQXRV.13.8.A08.1.454.CMB.2.raw
  modified_base (189)..(189): a, c, t, g, unknown or other
  misc_feature (189)..(189): n is a, c, g, or t
  modified_base (214)..(214): a, c, t, g, unknown or other
  misc_feature (214)..(214): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccgtcacttgccgggnaagtcagaccattgacaaatatgtaaattggtatcaacagaagccaggtgaacgcccctaagctcctgatctatactgcatccactttgtcaggcgggtccatccaaggttccgtgcagtggatcgtgggacagtatttcactctcacatcacagtctgcaacctgaagactgtcgacaactttacctactcgaccaacagttaccgttaaccggaaccctcgtaactacgttttcggacccgtacggggaccagggccgtaggaagaactaccgaaaacggtaacctaggtcggctacgaccacctacttccgtgtttacc

SEQ ID NO: 354325 - DNA, 587 bp, Homo sapiens
  misc_feature: GZ8MTXP02H2343.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacttgccgggcaagtcagaccattgaacaaattatagtaaaattggtatcaaacagaacgccaggtgaaacgcccctaagctcctagactctaatactgactatccctatttgcgaggggccggggtcccagtccgaacgggttccgtggacgtaggtggatcgtgggactagtattcactctacaccatccactgtctcgactaaccgtgaacgtacgtgtacgtacctaaactttactacttcgaccctaacgtacgttaccgttaaccggaacccttacgtaaccttacgtttcgaccgtacgggggtaccagggtcgtacggacgtaacgtaccgaaaacgtaacgtgtcggcgtacgaccactacttctacgtttacc

SEQ ID NO: 354326 - DNA, 550 bp, Homo sapiens
  misc_feature: GZ8MTXP02FXB0F.13.8.A08.1.454.CMB.2.raw
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
  modified_base (439)..(439): a, c, t, g, unknown or other
  misc_feature (439)..(439): n is a, c, g, or t
  modified_base (526)..(526): a, c, t, g, unknown or other
  misc_feature (526)..(526): n is a, c, g, or t
tcagtcacgtactacacgaccggtgctcgatttagcatactctacagtggggagtcagtctcagtcaggacacagcatggacatgagggtccccgctcagctcctggggctcctgctactctggctccgaggtgccagatgtgacatccagatgacccagtcctccatccctccctgtctgcatctgtagganacagagtcaccgtcacttggccgggnaagtcagaccattgaacaaatatagtaaattggtatacaaacagaagccaggtagaacgcccctaagctcctgatctatactgacacttcctacgttttgcgaggggtccggggtacccagtaccgtaaggttcccgtggctaggttgatcgtgggacagtatttcactcctcaccatccacattcagccaactagaagactgacactaacttactacgnaccaatacgtaccttaacgtacctcgttaactacgtttacggccgaacggggtacccgaggtccgtaggatacgtaacaaccggtanggtacgctacgctaactctcttcg

SEQ ID NO: 354327 - DNA, 526 bp, Homo sapiens
  misc_feature: GZ8MTXP02FPO6N.13.8.A08.1.454.CMB.2.raw
  modified_base (191)..(191): a, c, t, g, unknown or other
  misc_feature (191)..(191): n is a, c, g, or t
  modified_base (205)..(205): a, c, t, g, unknown or other
  misc_feature (205)..(205): n is a, c, g, or t
  modified_base (215)..(215): a, c, t, g, unknown or other
  misc_feature (215)..(215): n is a, c, g, or t
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
  modified_base (379)..(379): a, c, t, g, unknown or other
  misc_feature (379)..(379): n is a, c, g, or t
  modified_base (392)..(392): a, c, t, g, unknown or other
  misc_feature (392)..(392): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtnacttgccggnaagtcagaccattgaacaaatatagtaattgtatcaacagaagccaggtagaacgcccctaagcctcctgatctatactgcatccatttgtcgacggccgggtccatccgaggttccgtgctagngatcgtgggacagtntttcactctacacatccacagtcngacaacctgaaanctagtcgactaaacttacgtactgacccaacgagttacctaaccggaacctcgtacctacgtttcggacgaggggaccaggctagggacactacgaaaacgtacttggcggactgaccacacttccgtatttcc

SEQ ID NO: 354328 - DNA, 750 bp, Homo sapiens
  misc_feature: GZ8MTXP02HX4YU.13.8.A08.1.454.CMB.2.raw
  modified_base (192)..(192): a, c, t, g, unknown or other
  misc_feature (192)..(192): n is a, c, g, or t
  modified_base (220)..(220): a, c, t, g, unknown or other
  misc_feature (220)..(220): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtctccatccctcctgtctgcatctgtagganacagagtcaccgtcacgttggccggganaagtcaagacctattgaactaaatatagtaaattggtatacaacagaacgccaggtgaaacgcccctaagcctacctagactctaatactgactactcctactttgtcgaacggggtccggggtaccccaagttaccccgtaaacgggtttcccggtaggaccgtaagggttcgggaacttcggttacgggggaaactacggttacgttttacccaaccgttccttacccaaaccctacgtaccctaacccgtacggttaccctacgaccctaaacccgttagaaaacggtacccttaggttaccgtaaaccttaaacccgtttaacctacgttaccggaaaccctaaaccgtaccgttacgtttaaacccggtaacccgtttaccgttaaaccgttacccggtttttacgggaacccggttaaaccgggggtacccggacggttaggtacggtaaacgaccgttaaaccgaaaaccgtacggttacgtcggaccgttacggaccctaactacttcgttacgtttacccg

SEQ ID NO: 354329 - DNA, 536 bp, Homo sapiens
  misc_feature: GZ8MTXP02I9J7B.13.8.A08.1.454.CMB.2.raw
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgaacaatatagtaaattggtatcaacagaagccaggtgaacgcccctaagctcctgatctatactgctatcctatttgcagggccggggtcccatcccgtaaggtccgtggcaggtggatcgtgggacagtacttcactctaccacatcacagtctgacacctgaagtactagtcactaacttactactcgacctaacacgttaccgtaacggaccttcgtaacttacgtttacggccgtaggggtaccaggcgtaggagacgtacgaaaacgtactaggtcggctacgactaccacttcgtacttcc

SEQ ID NO: 354330 - DNA, 549 bp, Homo sapiens
  misc_feature: GZ8MTXP02I5EC0.13.8.A08.1.454.CMB.2.raw
  modified_base (215)..(215): a, c, t, g, unknown or other
  misc_feature (215)..(215): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacttgccgggnaagtcagaccattgacaaatatagtaaattggtatcaaacagaagccaggtcgaacgcccctaagctcctgatctatactgcatcctactttgtcgaggggccggggtcccatacccgtaagggttccgtggacctaggtggatcgtgggactagtatttcactctcaccatcaccagtctgacacctagaacgactagtcactaacttactactcgaccaactacgtaccgttacggaaccttcgtactacgtttggaccgtacggggaccgaggcgtaggaacgactaacgaaaacgtacgtggtaacggctacgacactactcgtcgttcc

SEQ ID NO: 354331 - DNA, 598 bp, Homo sapiens
  misc_feature: GZ8MTXP02F4CO6.13.8.A08.1.454.CMB.2.raw
  modified_base (223)..(223): a, c, t, g, unknown or other
  misc_feature (223)..(223): n is a, c, g, or t
  modified_base (349)..(349): a, c, t, g, unknown or other
  misc_feature (349)..(349): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtctccatccctcctgtctgcatctggtaggagacagacgtccaccgtcacgttggccggganaagtcagaccattagaacaaatatagtaaattggtatacaacagaagccaggtgaacgcccctaagcctctgatctatactgcatcctactttgcgagggccgggtccagtccgtaacggttccgnggcaggtggatcgtgggacagtacttcactcacaccatccactagtctagacaacctgaactctagtacgactaaacttactactcgaccaaacgtacgttaccgtaacggtaacccttcggttaacttcgtttacggaccgtacggggaccagggtacgtagggaacgtaacgttaaccgaaaaacggtaccgttagggccggttaccgtacggtacccaacccttagttaccgttcgtttaaccccg

SEQ ID NO: 354332 - DNA, 590 bp, Homo sapiens
  misc_feature: GZ8MTXP02FXTR7.13.8.A08.1.454.CMB.2.raw
  modified_base (205)..(205): a, c, t, g, unknown or other
  misc_feature (205)..(205): n is a, c, g, or t
  modified_base (366)..(366): a, c, t, g, unknown or other
  misc_feature (366)..(366): n is a, c, g, or t
  modified_base (403)..(403): a, c, t, g, unknown or other
  misc_feature (403)..(403): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtnacttgccgggcaagtcagaccattgaacaaatatgtaaattggtatcaacagaagccaggtgaacgcccctaagctcctgatctatactgcatccatttgtcacgggcggggtcccatccgaaggttccgtggcagtggatcgtgggacagtattcactcncaccatccaccagtctgacaacctgaaacgtctagtnacctaaacttactacgtacgaccctaaacgtacgtaccgttaaccggaacccttcgttaacctacgttttacgggaccgtaacgggggacccaggggtccgtaggggaaacgtacgttaccgaaaaaccggtacgttaggttaacggggccttacggaccctaaccgtaacgttcctacggtttccc

SEQ ID NO: 354333 - DNA, 552 bp, Homo sapiens
  misc_feature: GZ8MTXP02I6W5X.13.8.A08.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (368)..(368): a, c, t, g, unknown or other
  misc_feature (368)..(368): n is a, c, g, or t
  modified_base (392)..(392): a, c, t, g, unknown or other
  misc_feature (392)..(392): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggnaagtcagaccattgacaaatatgtaaattgtatcaaacagaagccaaggtgaacgcccctaaagctcctgaatctaatactgcactcctactttgtcagggccggggtcccatccgtaacggttccgtgactagtggatcgtgggaactagtntttcactctcaccgatcacagtcngaccactagaagactgtcactaacttactactgacccaatagttaccttaacggaaccttctaactcgtttacggaccgacgggggtaccaggtctagggaaatactaacgaaaaccgtcgttaggcggcttacgacctaaccgtcgttccgtttatccc

SEQ ID NO: 354334 - DNA, 554 bp, Homo sapiens
  misc_feature: GZ8MTXP02G5EX4.13.8.A08.1.454.CMB.2.raw
  modified_base (218)..(218): a, c, t, g, unknown or other
  misc_feature (218)..(218): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccgtcacttgccgggnaagtcagacatgaacaaatatagtaaattggtatcaacagaagccaggtagaacgcccctaagctcctgactctatactgcatccactttgtacaggccggggtcccagtccgaacggttccgtggactagtggatcgtagggacagtattcactctccaccatccacagtctgacaaccgtgaacgctgtcgactaaacttactactgaccaactacgtaccttacggaacctcgtaactcgtttcgggcccgtaaggggaccgaggcgtaggaagtacgtaacgaaacggtaacgtggcggtacgtacggaccaactcgttcttacggtttccc

SEQ ID NO: 354335 - DNA, 598 bp, Homo sapiens
  misc_feature: GZ8MTXP02HTQ0X.13.8.A08.1.454.CMB.2.raw
  modified_base (219)..(219): a, c, t, g, unknown or other
  misc_feature (219)..(219): n is a, c, g, or t
  modified_base (260)..(260): a, c, t, g, unknown or other
  misc_feature (260)..(260): n is a, c, g, or t
  modified_base (406)..(406): a, c, t, g, unknown or other
  misc_feature (406)..(406): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttcggccggganagtcagacctattagaacaaatatagtaaattggatacaanagaacgcaggtagaacgaccctagctcctagatctatactgactactcctacgtttgcgacgggtccggggtccataccgtaacggtttcccgaggtctaggtcggattcggtagggaactagtacttacactactcccaacctanacccacgtacgttcgacgtaccaaccgtagaacgtacttgtacgaaccttaacttactacgtcgaccctaacgtacgttaccgtaaccgtacctacgttactacgtttccggacgaacggtacaggcgtaacgacgtactaacgaaacgtaacgtcgtaacggacctacgaccaacttctcgtttacttacc

SEQ ID NO: 354336 - DNA, 601 bp, Homo sapiens
  misc_feature: GZ8MTXP02JQF5Y.13.8.A08.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (349)..(349): a, c, t, g, unknown or other
  misc_feature (349)..(349): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggnaagtcagaccattgactaaatatagtaaattggtatcaacagaagccaggtagaacgcccctaagcctacctgactctatactgctactcctactttgcgaggtccggggtacccatacccgtagggttccgngactaggtgatcgtgggacagtacttcactctacaccataccactagtctgaccaactgaacgtctcgtacactaaccgttactactacgaccctaacgtacgttaccgttaaccggtaacccttcgttaaccttaccggttttacgggacccgttaacggggttaccccgagggtaccgtacgggaagtaacgtaaccgaaaaccgtacgtacggtcggtacctacggaccacctacgttctacgtttccc

SEQ ID NO: 354337 - DNA, 579 bp, Homo sapiens
  misc_feature: GZ8MTXP02IMM0M.13.8.A08.1.454.CMB.2.raw
  modified_base (202)..(202): a, c, t, g, unknown or other
  misc_feature (202)..(202): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctcctgtctgcatctgtagagacagagtcaccgtnacttggccgggcaagtcaagaccattgaacaaatatgtaaaattggtatcaaacagaagccaaggtgaaacgcccctaaagcctcctgatctatactgcatcctatttgcgacggtcgggtacccagtccgaaggttccgtggctaggtgatcgtgggacagtattcactctacacatcacagtctgacaactgaagactgtacgacctaaacttactaactcgacctaaacgacgttaccgttaaccggaaccttcgtaacttacgtttaggaccgtaacggggaccacgggtactacgggaagtaacctaaccgaaaaacgtaaccgttggtaacgggtacctacggtaccaaaccttacgtacctttggtaccc

SEQ ID NO: 354338 - DNA, 774 bp, Homo sapiens
  misc_feature: GZ8MTXP02H9N1U.13.8.A08.1.454.CMB.2.raw
  modified_base (217)..(217): a, c, t, g, unknown or other
  misc_feature (217)..(217): n is a, c, g, or t
  modified_base (259)..(259): a, c, t, g, unknown or other
  misc_feature (259)..(259): n is a, c, g, or t
  modified_base (294)..(294): a, c, t, g, unknown or other
  misc_feature (294)..(294): n is a, c, g, or t
tcagtcacgtactacacgaccggtgctcgatttagcatactctacaggggggagtcagtctcagtcaggacacagcatggacatgagggtcccgctcagctcctggggctcctgctactctggctccgaggtgccagatgtgacatccagatgacccagtctccatcctcctgtctgcatctggtaggagacagagtcaccgtcacttcggccgggnaagtcagacctattagaactaaatatagtaattggatacaanagagcaggtgaacgccctaagctcctgatcatacngacactcctatttgacgacggggtccgggtacctagtacccggtaaacgggtttcccggtaggaccggttaggtacgggttaacttcgggtacgggggtaactacgggtttaattttaccacccgttacttacccacccgtaatacccgtaaccgtacgtttaccgacgtaaaccctaaacccggttaggaaaccctacggttacgtaacgtaaaccctttaaaccttttaaaccgaacgttaccgaaacccgtaaacgttaaccgtttacccggtttaaaaacccgggtaaaccctttacccggtaaacgtttttaacccggttacggggaaaccccgggaaacgggggttacccaaaagggggtttcccgtaaaggggaaaacctaaacgttaaaccgaaaaacccgggttagttcccggtaaggttaaacccgcggtaaacccgtaccctttaaggttaaccggtttctttaacccg

SEQ ID NO: 354339 - DNA, 627 bp, Homo sapiens
  misc_feature: GZ8MTXP02I0HSW.13.8.A08.1.454.CMB.2.raw
  modified_base (191)..(191): a, c, t, g, unknown or other
  misc_feature (191)..(191): n is a, c, g, or t
  modified_base (362)..(362): a, c, t, g, unknown or other
  misc_feature (362)..(362): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttggccgggacaagtcagaccattgaacaaatatagtaaattggtatacaaacagaacgccaaggtagaacgcccctaagctcctagatctaatactgactatccctagtttgacgacgggccgggtacccaagtacccgtaagggtttcccggnggacgtaggtgacgtcggtagggaactagttacttacactcacactactacactagtctacgacaacgtagaacgtacgtagtactaacctaaacttaacgtaactacgaaccaaacgtacgttaaccgttaaccggtaaccgttacgtaacgttaccgtttaccgggaaccggtaacgggtaccgacggtacggtaacggaaacgtaaacgtaacgaaaacgtacgtacggaacggtacgtacgaccacctacttacgtacttc

SEQ ID NO: 354340 - DNA, 562 bp, Homo sapiens
  misc_feature: GZ8MTXP02HX82D.13.8.A08.1.454.CMB.2.raw
  modified_base (190)..(190): a, c, t, g, unknown or other
  misc_feature (190)..(190): n is a, c, g, or t
  modified_base (215)..(215): a, c, t, g, unknown or other
  misc_feature (215)..(215): n is a, c, g, or t
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
  modified_base (414)..(414): a, c, t, g, unknown or other
  misc_feature (414)..(414): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtccacgtcacttgccgggnaagtcagaccattgaacaaattatagtaaattggtatcaaacagaacgccgaggtgaaacgcccctaagcctcctgactctatactgcactccctatttgcgagggccggggtccagtccgtaaggttccgnggcaggtggatcgngggacagtatttcactctcacatcacagtctgacaaccgtagaacgactgtanactaactttacacttcgaccctaagacgttacgtaacggaacccttcgtaactacgtttaggacccgtaacggggaccagggtcgtaggaactacgtacgaaaacgtacgtggtaacgtacgtacgaccaccgtacttccgttactcc

SEQ ID NO: 354341 - DNA, 559 bp, Homo sapiens
  misc_feature: GZ8MTXP02F9PMH.13.8.A08.1.454.CMB.2.raw
  modified_base (345)..(345): a, c, t, g, unknown or other
  misc_feature (345)..(345): n is a, c, g, or t
  modified_base (357)..(357): a, c, t, g, unknown or other
  misc_feature (357)..(357): n is a, c, g, or t
  modified_base (374)..(374): a, c, t, g, unknown or other
  misc_feature (374)..(374): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcacgtcacttgccgggcaagtcagaccattgaacaaatatagtaaattggtatacaaacagaacgccgaggtcgaaacgcccctaaagccttcctgatctaatactgcatccctactttgcaggcggggtcccatccgtaggttccgngcagtggatcgngggacagtattcactcncaccatcactagtctgacaacctgaacgcgtagtcaactaacttaactactacgaccctaacgtacgttaccgttacggtaacctcgttacctacgttttacggaccgtacggggaccagggtcgtacggagacgtaacgtaaaacgaacttggcggtctaacggcaaccttactacgtacttac

SEQ ID NO: 354342 - DNA, 819 bp, Homo sapiens
  misc_feature: GZ8MTXP02H3S6H.13.8.A08.1.454.CMB.2.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccactcctccctgtctgcatctgtagganacagagtcacgtcacttgccgggnaagtcagacattgaacaaatatagtaaattggtaatacaaacagaacgccgaaggtacgaacgccccgtaagcctacctagatctatactgactactcctacttttgacgacggggtcccggggtaccctagtcccgtaaacgggtttccccggtagggaccgtaaggttcgggtaacttccgggttaggggaaaccgtaaggttacctttttccaaccgttccctaccctaaccctaactaccctaacccgtaacgttcccgtacggtaaaccctaaaccccgttaggtaaacgtaaaccgttcggtaacgtaacccttaaaacgtttaacccttaaaccgtttacgaaacccccgtaaaacgttaaccggtttaaccccgtttaaacccggggtaaaccctttaaccggttaacccgtttaacccggtttttacgggaaccccgggtaaaacgggggtaaaccccgtacggggtaccggttaacgggaaaccggttaaacgttaaacccgtaaaaaaccggtaaccgttacggggttaacgggtacccgtttaaacgggacccgtaaaacccctacgtttaccggtttaaccgttttcccg

SEQ ID NO: 354343 - DNA, 533 bp, Homo sapiens
  misc_feature: GZ8MTXP02JP0SX.13.8.A08.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (333)..(333): a, c, t, g, unknown or other
  misc_feature (333)..(333): n is a, c, g, or t
  modified_base (341)..(341): a, c, t, g, unknown or other
  misc_feature (341)..(341): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggnaagtcagaccattgacaaatatagtaaattggtatcaaacagaagccaggtgaacgcccctaagctcctgactctatactgcatccatttgcaggtcggtccatccgtaggttccgngcagtgancgtgggacagtatttcacttctcaccatccgacagtctgacacctgaacgtctgcactaaacctttacacgtacgaccctaaagtcgttaacccgtaacggtaccttcgtaacttacgtttagggccgtaagggaccagggtctaggagactacgaaacgactgaaggctacgactacgtacttcagtttcc

SEQ ID NO: 354344 - DNA, 585 bp, Homo sapiens
  misc_feature: GZ8MTXP02FTLNQ.13.8.A08.1.454.CMB.2.raw
  modified_base (220)..(220): a, c, t, g, unknown or other
  misc_feature (220)..(220): n is a, c, g, or t
  modified_base (364)..(364): a, c, t, g, unknown or other
  misc_feature (364)..(364): n is a, c, g, or t
  modified_base (395)..(395): a, c, t, g, unknown or other
  misc_feature (395)..(395): n is a, c, g, or t
  modified_base (399)..(400): a, c, t, g, unknown or other
  misc_feature (399)..(400): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
tcagtcacgtactacacgaccggtgctcgatttagcatactctacagggggggagtcagtctcagtcaggacacagcatggacatgggggtccccgctcagctcctggggctcctgctactctggctccgaggtgccagatgtgacatccagatgacccagtctccatcctccctgtctgcatctgtaggagacagagtcaccgtcacgttggccggganaagtcagacctattgaacaaattatagttaaaattggtaatacaaacaagaaagccgaggtagaaacgtccccctaagcctcctagatctatactgactactcctactttgcgagggtccgggtacccatcgtaacggttccgngcaggtggattcgtgggacagtattcactcncacnncactntcngactaactgaactctgacgaccttaaacttacctacgtacaccctaaacgtacgttaccgttaacccggaccttaccgttacttacgtttcgggaccgacggggtaccaggtcgtaggacgaactaacgaaaacgacgtggcggaactcgacctacctgttactcgttcctttaccg

SEQ ID NO: 354345 - DNA, 569 bp, Homo sapiens
  misc_feature: GZ8MTXP02HQ0OY.13.8.A08.1.454.CMB.2.raw
  modified_base (212)..(212): a, c, t, g, unknown or other
  misc_feature (212)..(212): n is a, c, g, or t
  modified_base (403)..(403): a, c, t, g, unknown or other
  misc_feature (403)..(403): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcacgtcacttgccggnaagtcagacatgacaaatatgtaaatggtatcaaacagaagccaggtgaacgcccctaaagctcctgatctaatactgctaatcctacttttgcgacgggtccggggtcccagtcccgaaacgggttccgtggcaggtggatcgtgggacagtatttcactctcacatcaccagtctgacaacctagaaanactgtacactaacttactactacgacaacgtacgtacgtaaccgaccttacgtaacgtacgtttacggaccgtaacgggtaccgacggtacgtacggaacgtaacgtaaccgaaaacgtacgtcggtaacggtactacgacctaacctacttaccgttacgttccg

SEQ ID NO: 354346 - DNA, 557 bp, Homo sapiens
  misc_feature: GZ8MTXP02J1DRQ.13.8.A08.1.454.CMB.2.raw
  modified_base (366)..(366): a, c, t, g, unknown or other
  misc_feature (366)..(366): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacgttggccggcaagtcagaccattgaacaaatatagtaaattggtatacaacagaagccgaggtagaaccgcccctaagctcctagatactatactgacactccctatttgcgacgggcgggtacccagtccgtaacggttcgtggcgtagtggattgngggacagtactttcactcacacctactacaccgtagtctcgactacccgtagaacgtcgtagtacgtactaaacttactacgtcgaaccaacgtacgtactaccgtaacctcgtactcgtttacgaccgaggaccgaggcgacggtagactacgaaacgtacgtagaagtcgacgctacgactcgtctacc

SEQ ID NO: 354347 - DNA, 580 bp, Homo sapiens
  misc_feature: GZ8MTXP02G3QRD.13.8.A08.1.454.CMB.2.raw
  modified_base (259)..(259): a, c, t, g, unknown or other
  misc_feature (259)..(259): n is a, c, g, or t
  modified_base (390)..(390): a, c, t, g, unknown or other
  misc_feature (390)..(390): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttggccgggcaagtcagaccattgaactaaatatagtaaattggtatcaaanagaacgccaggtgaacgcccctaagcctctgatctatactgctactcctactttgcgaggggccgggtacccatcccgtaacgggttccgtggacgtaggtcgatcgtgggactagtacttcactctcacntcacagtcngacactaganactgtcgactaacttactactcgacctaacgtacgtaccgttaaccggaacctcgttaaccgttacgtttacgggaccggtaacggggtacccgtaggacgtacgggaaataaacgtacgtaaaaccggaacttcgggaacggctacggacctacctattcgttacgtttc

SEQ ID NO: 354348 - DNA, 669 bp, Homo sapiens
  misc_feature: GZ8MTXP02JH2PW.13.8.A08.1.454.CMB.2.raw
  modified_base (323)..(323): a, c, t, g, unknown or other
  misc_feature (323)..(323): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagatccaccgtcacgttcggccgggacaagtcacgacctattagaactaaatatagttaaagttggtaatacaaacgaagaagtccgaaggtacgaaacgcccctaagcttcctagacttactaatacgtncacttcctacgtttgacgacgggccgggtaccctatacccgtaacggttccgtgaccgtaggtaggacttcggtacggggaactaggtactttccgaacctctaccaaaccctctaccaccgaacgttcctacggtaacctaaacccaggtaaacgtacgtacgtacgtaacctaaactttaactttaccgtacgacccaaacggttaacgttaccgttaaaccgaacccgttactaccgttaacggtttcggaccggaacggggtaccgacgggttacgaccggaaagtactaaccgtaaaacggacgttgaacggtcgtacaccgtacacttcgttcttacccg

SEQ ID NO: 354349 - DNA, 695 bp, Homo sapiens
  misc_feature: GZ8MTXP02JJ3VP.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatcgacccagtcctccatccctccctgtctgcatctgtaggagacagagtcaccgtcacgttggccgggcaagtcagacctattgaacaaatatagtaaattggtatacaacagaagccaggtagaacgcccctaagctcctgatctaatactgacactccctactttgccgacggggtccgggtaccctagtaccccgtacgggttccgtaggcgtaggtggtactcggtaggggaactaaggttactttaccaaccctttcaccctaccctaacttcccaaacccgtggtaccttacgacctaaacccgtagtaaacgtaccgttagtaacgtaaccttaaaccttacgtaccttacgaaccctaacgtacgttaacccgttaaccggtaaccgttaccgttaacgttaaccgtttttcggggaaccgacgggggtaaccctagggaccgttaaacggggactaaccgttaaaccgaaaacggttaccggtaggttcggaccttacggaccccttaaaccgtacgtttccgtttcgttaccg

SEQ ID NO: 354350 - DNA, 587 bp, Homo sapiens
  misc_feature: GZ8MTXP02JMBK8.13.8.A08.1.454.CMB.2.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (568)..(568): a, c, t, g, unknown or other
  misc_feature (568)..(568): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggnaagtcagaccattgaacaatatagtaaattggatcaacagaagccaggtgaacgccctaagctctgatctatactgcactcctatttgcgaggtccggggtaccagtaccgtacgggttccgtggacgtaggtggatcggtagggaattagtacttcgactctacacatcacctagtctagacaacctagaacgtactgtacactaacctttactacgtacgaccctaaacgtacgttaccgttaaccggtaacccttacgtaaccgttaccggttttacggacccggttaacgggggtaacccgagggtccgtagggaacgtacgtacgaaaacgtacgttggcggtacncgactactactcgtacgtc

SEQ ID NO: 354351 - DNA, 582 bp, Homo sapiens
  misc_feature: GZ8MTXP02H8U1O.13.8.A08.1.454.CMB.2.raw
  modified_base (215)..(215): a, c, t, g, unknown or other
  misc_feature (215)..(215): n is a, c, g, or t
  modified_base (397)..(397): a, c, t, g, unknown or other
  misc_feature (397)..(397): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacttgccgggnaagtcagaccattgaacaaatatagtaaattggtatacaaacagaagccaggtgaacgcccctaagctcctgatctatactgactatcctatttgcacggggccgggtcccatcccgaaggtttccgtgcgtaggtggatcgtagggactagtactttcactctccacctatccactagtcngacaactgaagctgtacactacttactactcgacctaacgacgttaccgttaaaccggaacctttcggtaacctttaccggtttacgggacccggtaaacgggggtacccagggtccgtaggtacgaacgtaaaccgaaaacgtaacgtggtaacggtctcggacctaccgtacttcgtcttccc

SEQ ID NO: 354352 - DNA, 568 bp, Homo sapiens
  misc_feature: GZ8MTXP02IQ23W.13.8.A08.1.454.CMB.2.raw
  modified_base (191)..(191): a, c, t, g, unknown or other
  misc_feature (191)..(191): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagacgtcaccgtcacgttgccgggcaagtcagaccattgaacaaatatagtaaattggtatcaaacagaacgccaggtacgaacgccccctaaaggcctcctgactctaatactgcactccctactttgtcaggccggggtccatcccgtaaggttcccgtggcaggtggatcgtagggacagtactttccgactctacaccatccacagtctgacacctgaagtactgtcgactaaacttactacttgaccctaacacgttaccttacggaaccttcgtaactacgtttaggaccgaggggtacccaggtcgtcgggaactacgtaacgaaaacgtacgtagtcggtacgtacgaccaccacgttctcgtttcc

SEQ ID NO: 354353 - DNA, 544 bp, Homo sapiens
  misc_feature: GZ8MTXP02GV7XC.13.8.A08.1.454.CMB.2.raw
  modified_base (133)..(133): a, c, t, g, unknown or other
  misc_feature (133)..(133): n is a, c, g, or t
  modified_base (262)..(262): a, c, t, g, unknown or other
  misc_feature (262)..(262): n is a, c, g, or t
  modified_base (295)..(295): a, c, t, g, unknown or other
  misc_feature (295)..(295): n is a, c, g, or t
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (410)..(410): a, c, t, g, unknown or other
  misc_feature (410)..(410): n is a, c, g, or t
tcagtcacgtactacacgaccggtgctcgatttagcatactctacagggggagtcagtctcagtcaggacacagcatggacatgagggtccccgctcagctcctggggctcctgctactctggctcccaggtnccagatgtgacatccagttgacccagtctccatccttcctgtctgcatctgtaggagacagagtcaccatcacttgccgggcagtcaggacattaacagttattagtctggtatcagacaaaaaaccgngggaaaactccctaagctcctagatctatgttncatccatttgctaaagtgggtccatcaagttnacgcggnagtggatcgtagggcagtattcactctacacaatcagcagcctgcagcctagaatntttanacttaaattacttangtacaagtatacttaagtacgtacctctacgtggttacggacggtaacgggaacgtagggtaggacgtaactaaacgaaaacggtacgtggtacggaacgtacgaaccgtaactattccgtacgtttacttacg

SEQ ID NO: 354354 - DNA, 604 bp, Homo sapiens
  misc_feature: GZ8MTXP02G0BER.13.8.A08.1.454.CMB.2.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggnaagtcagaccattgaacaaatatagtaaattggtatcaanagaagccaggtanaacgcccctaagctcctgatctatactgcatcctactttgtacgagggccgggtcccatcccgaaggttccgtggctaggtggatcgtgggactagtatttcactctaccacatccaccagtctgaccaaccgtgaacgtactgtacgactaacttactactagaccctaactacgttaccttaaccggtaccttacgttaaccgtacgttttaccgggacccgtaacgggggaaccgtacgggtccgttaggggaacgtaaacgtaccgtaaaaaccgtaccgttggtaacgggttcctacggacctaaccctagttaccggttacgtttcccg

SEQ ID NO: 354355 - DNA, 606 bp, Homo sapiens
  misc_feature: GZ8MTXP02I0NHR.13.8.A08.1.454.CMB.2.raw
  modified_base (217)..(217): a, c, t, g, unknown or other
  misc_feature (217)..(217): n is a, c, g, or t
  modified_base (338)..(338): a, c, t, g, unknown or other
  misc_feature (338)..(338): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttggccgggnaagtcagaccattgacaaatatagtaaattggtatcaaacagaagccagtgaagacccctaagctcctgatctatactgcatccctatttgtcaggcggggtcccatccgaacggttccgngcagtggntcgtgggangtatttcgacttccacacctactcaccacgtcgttcgacaacccttagaacgaccgtagtcgactaaacttactaccgtcgacccaaactacgttaccgttaaccggtaaccttccggttaacctacgtttttacgggccgtaacgggggtacccgaaagggtccgtaaggggtaactaacgtaaccgaaaaaccgtaacgtaacggtcgggtaaccgttcggaccctaaccgtacttacgttcgtttacc

SEQ ID NO: 354356 - DNA, 681 bp, Homo sapiens
  misc_feature: GZ8MTXP02JIK1L.13.8.A08.1.454.CMB.2.raw
  modified_base (193)..(193): a, c, t, g, unknown or other
  misc_feature (193)..(193): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatcgacccagtcctccatcctcctgtctgcatctggtagganacagagtccaccgtcacgttcggccgggcaagtcagacctattgaactaaattatagtaaattggtaatacaacagaagccaggtacgaacgcccctaaagcctcctagactctaatactgacacttccctactttgcgagggtccggggtaccctagtacccgtaacgggttccgtggaccgtaggtaggaacttcggtaggggaactacggttactttacctactaccttccaaaccctatacccaacccgtaacgtccttacgacctaacccgtaggaaacgtaccttgtaacgtacctaaacctttaaccaacgttacgaccctaaacgtacgttaccgtaaccggtaacccttcgtaaccttaacgtttcggaccggacggggaccgtacgggtacgtaccgggaagtaacgtaccgtaaaacggtaaccgttgggtaaccgggtcttaaccggactacccgtagtttccgtacgtttacccc

SEQ ID NO: 354357 - DNA, 620 bp, Homo sapiens
  misc_feature: GZ8MTXP02HHSDK.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccgtcacttgccgggcaagtcagaccattgaacaaatatagtaaattggtatcaaacagaagccaggtgaacgcccctaagctcctgatctatactgctatcctactttgcgacgggccgggtcccatcccgaaggttccgtggcagtggatcgagggacagtacttcactctaccacctataccacctagtcctacgacctaaccgtagaaacgtactagtacgtacctaaacctttaactactacgaccctaaactacgttaccgttaaccggtaaccttaccgttaacgttaccggttttacggaccggtaacggggtaaccgtacgggccgttagggaacggtaacttaaaccgaaaaccggtaacgttagggtaacggtcgtacggacctaacctacgttaccgttacgtttcccg

SEQ ID NO: 354358 - DNA, 640 bp, Homo sapiens
  misc_feature: GZ8MTXP02JCQVF.13.8.A08.1.454.CMB.2.raw
  modified_base (192)..(192): a, c, t, g, unknown or other
  misc_feature (192)..(192): n is a, c, g, or t
  modified_base (218)..(218): a, c, t, g, unknown or other
  misc_feature (218)..(218): n is a, c, g, or t
  modified_base (289)..(289): a, c, t, g, unknown or other
  misc_feature (289)..(289): n is a, c, g, or t
  modified_base (349)..(349): a, c, t, g, unknown or other
  misc_feature (349)..(349): n is a, c, g, or t
  modified_base (403)..(403): a, c, t, g, unknown or other
  misc_feature (403)..(403): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttggccgggnaagtcagaccattgaacaaatatagtaaattggtatcaaacagaagccaggtagaacgcccctaagctccngatctatactgcatccctatttcgtcgagggtccggggtacctagtccgtaaggttccgnggcaggtggatcgtgggacagtactttccacgtcctcaccactcacctaggtcngaccaaccgtagaacgtacgtgtacgactaaccgtttaactaccgttacgaccctaacgtaacgttaccgttaaacccggtaccttaccggttaactaccggttttacggaccggtacgggggaaccgtaggggtaccgtacgggaaacgtaacgtaccgaaaaaccggtaacgttacgggtaacgggtacccgttacggaccctaacccggtacttacccgttacggttttacccc

SEQ ID NO: 354359 - DNA, 556 bp, Homo sapiens
  misc_feature: GZ8MTXP02FVHPJ.13.8.A08.1.454.CMB.2.raw
  modified_base (191)..(191): a, c, t, g, unknown or other
  misc_feature (191)..(191): n is a, c, g, or t
  modified_base (301)..(301): a, c, t, g, unknown or other
  misc_feature (301)..(301): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggcaagtcagaccattgaacaaatatagtaaattggtaatcaaacagaacgccgaaggtagaacgcccctaagcctctgatctatacngcactcctatttgcgagggtcgggtccataccgtacggttccgtggctaggtggatcgaggacagtattccatctacactatccacagtctagaccaacgtagaacgtctagtacactaaacttactactgacctaactagtacccgtaacgtaaccgtcgttaactcgtttaggaccgaggggtacccagggaccgtagggaactactaacgaaaacgtcgtacgtggtctacgaccactactctacgtttccc

SEQ ID NO: 354360 - DNA, 768 bp, Homo sapiens
  misc_feature: GZ8MTXP02JO0JQ.13.8.A08.1.454.CMB.2.raw
  modified_base (191)..(191): a, c, t, g, unknown or other
  misc_feature (191)..(191): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtccaccgtcacgttcggccgggacaagtcagaccattcgaactaaatatagtaaattggtatacaaacgagaacgccgaaggtacgaaaccgcccctaaagccttacctagtactttacgtaatacgtgacctaactttacccttaacgtttttcggaccgtacgggggtccccggggtacccctaagttaccccggtaaacggggtttcccggtaggaccgtaagggttcgggaacttccggggtagggggtaacctacgggtttaacttttcccgaaacctttccgttaacccaaccgtaacttaccccgaaccgtaacggttcctaacggaaacctaaacccgttaggaaaaccgttctacggttctaaacccttaaacttttacccaacgtccgaaccctaaacggttacgttaacccgttaaacccgggtaaccccttagggttaaccctttaccggtttacggggaccccgggtaaacgggggtacccaggggtcgtaacgggaactaacgttaaaccgaaaacggtcgtgggaacgtctaccggctaactcttcggtctttacc

SEQ ID NO: 354361 - DNA, 608 bp, Homo sapiens
  misc_feature: GZ8MTXP02FWB6T.13.8.A08.1.454.CMB.2.raw
  modified_base (216)..(216): a, c, t, g, unknown or other
  misc_feature (216)..(216): n is a, c, g, or t
  modified_base (348)..(348): a, c, t, g, unknown or other
  misc_feature (348)..(348): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggnaagtcagaccattgaacaaatatagtaaattggtatcaaacagaagccaggtagaagcccctaaagctcctgatctatactgcatccactttgtcaggcgggtccatccgaaggtccgtggcagtggatcgngggacagtactttcactctacacatcaccagtctgacaacctgaaacgtctagtgaacctaaactttaaacctacgtacgaccctaaactacgttaacccgttaaccgggaaacccttaccggttaaaccttaccgttttacggggaacccgtaacgggggaacccctagggcccgttacgggaaagtaacgttaccgaaaaacggtaccgttaggtaacgggtcttacggacctaacccgtattccttacggtttaccc

SEQ ID NO: 354362 - DNA, 591 bp, Homo sapiens
  misc_feature: GZ8MTXP02GT42O.13.8.A08.1.454.CMB.2.raw
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttggccgggcaagtcagaccattgaacaaatatagtaaattggtatcaaacagaagccaggtgaacgcccctaaagctcctgatctatactgctatccctactttgcgagggtccggggtcccatccgaacggttccgtggcaggtgatcgtagggactagtctttcactctaccacatcactacgtctagactaacctgaaacgtactgtacgtactaaaccttactactacgaccctaaacacgttacctaaccggtaacccttcgtaacttaccgttttacgggacccggtaaacgggggtaccgagggtaccgtacgggagtaacgtaaccgaaaacgtacggtacggtaacggcacggacaccgtattcgtacgtttcc

SEQ ID NO: 354363 - DNA, 543 bp, Homo sapiens
  misc_feature: GZ8MTXP02GIGG8.13.8.A08.1.454.CMB.2.raw
  modified_base (479)..(479): a, c, t, g, unknown or other
  misc_feature (479)..(479): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggacaagtcagaccattgaactaaatatagtaaattggtatcaacagaagccaggtgaacgcccctaagctcctgatctatactgctactcctactttgtcgaggccggggtaccagtcccgaaggttccgaggcaggtggatcgtgggactagtacttcactctcacatcacatctgacaccgtagaacgtctgagactaacttactactcgaccaatacgtaccgttaacggacttcgtactcgtttacgaccgtacgggaccnggtacgtgggaaactacgtaaccgaaaacgtacgtgtaacggctacgactacactctcgttacc

SEQ ID NO: 354364 - DNA, 547 bp, Homo sapiens
  misc_feature: GZ8MTXP02F91KO.13.8.A08.1.454.CMB.2.raw
  modified_base (218)..(218): a, c, t, g, unknown or other
  misc_feature (218)..(218): n is a, c, g, or t
  modified_base (489)..(489): a, c, t, g, unknown or other
  misc_feature (489)..(489): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttggccgggnaagtcagaccattgaacaaatatgtaaattggtatcaaacagaagccaggtgaacgcccctaagctcctgatctatactgcatccatttgcaggcgggtccatccaggtccgtgcagtggatcgtgggacagtacttcactctcaccatccacagtctgacaacctgaacgtctgtacgactaaactttactaactcgaccaaactagttaccttaccggaacctcgtaacctacgtttacggaccgtaacggggaccagggctagggganaacgtacgaaaacggtaactgggtcggtactggacccaacctactccgttacgtttcc

SEQ ID NO: 354365 - DNA, 550 bp, Homo sapiens
  misc_feature: GZ8MTXP02IRG5X.13.8.A08.1.454.CMB.2.raw
  modified_base (214)..(214): a, c, t, g, unknown or other
  misc_feature (214)..(214): n is a, c, g, or t
  modified_base (441)..(441): a, c, t, g, unknown or other
  misc_feature (441)..(441): n is a, c, g, or t
tcagtcacgtactacacgaccggtgctcgatttagcatactctacagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccggnaagtcagaccattgaacaaatatgtaaattggtatcaaacagaagccaggtagaacgcccctaaagctcctgatctatactgcattccctactttgtacgaggccggggtcccagtccgtaaacggttccgtaggctaggtggatcgtagggactagatttcactctacaccatcaccagtctgacaacctgaagactgtacgactaaccttactactgaccctaanacgttctaaccggaaccttcggtaactacgtttcggaccgtaacggggacctaggcgtaggaacgactacgaaaacgtacctggtggctcgacaacctctctgtttacc

SEQ ID NO: 354366 - DNA, 648 bp, Homo sapiens
  misc_feature: GZ8MTXP02HG4QT.13.8.A08.1.454.CMB.2.raw
  modified_base (219)..(219): a, c, t, g, unknown or other
  misc_feature (219)..(219): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacgttggccgggnaagtcagaccagttgaacaaatatagttaaattggatcaaacagaagccaggtagaacgcccctaagctcctagactctatactgctatcccgttatttgacgacggggtccggggtacccagtaccgtaacgggttccggtacggctaggtcggaacttcggaggggactaaggtctttaccgacttctaccaacctactacccacctagtctacgacctaacccgtgaaacgtacttagtacgtaaccttaaacctttaacgtacgtactaacccgtaacgtaaccgttaaccttaaccggtaaccttaccggttaacttacggtttacggacccggtacggggtaaccgcggtacgtagggtacaaactaccgtaaaacgacgttacggcgtacgtacgacgtaacctacttaccttcgtttaccc

SEQ ID NO: 354367 - DNA, 578 bp, Homo sapiens
  misc_feature: GZ8MTXP02IM3F3.13.8.A08.1.454.CMB.2.raw
  modified_base (429)..(429): a, c, t, g, unknown or other
  misc_feature (429)..(429): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccactcctccctgtctgcatctgtaggagacagagtcaccgtcacttcggccggacaagtcagacctattagaactaaatatagtaaattggatacaacagaagccgaaggtacgaacgacccctaagcctctagtatactaatactgactattcctacttgtcgacgggtccgggtacctagtaccgaacggttccgtggctagtcggactcgtggacagtactttcactcacactactacactagtctacgtacaacctagaanacgtagtactactaaacttactactacgactaactacgtacgtaaccgtaccttacgtacttacgtttcgacgtacggtacgacgtagtacggtaagaactacgaaaacgtaacgtagtaaggtctacgaccactacttcgtactttcc

SEQ ID NO: 354368 - DNA, 635 bp, Homo sapiens
  misc_feature: GZ8MTXP02IQIU4.13.8.A08.1.454.CMB.2.raw
  modified_base (288)..(288): a, c, t, g, unknown or other
  misc_feature (288)..(288): n is a, c, g, or t
  modified_base (338)..(338): a, c, t, g, unknown or other
  misc_feature (338)..(338): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatcgacccagtctccatccctccctgtctgcatctggtaggagacagagtccaccgtcacttggccgggacaagtcagacctattgaacaatatagtaaattggtatcaacagaagcaggtgaacgccctaagctcngtatctatactgcatcctactttgcgaggccggtccagtccgagttccgngctaggtgatcgtgggactagtactttcactctaccacctatccactacgtctcgactaacctgaacgtacgtagtacgtacctaaaccgtttacctactacgtaccctaacgtaaccgttaccgttaacccgggtaaccccttaccggttaaaccgtttaccggttttacgggacccgggtaaacgggggtaacccgaacgggtcggtaacggtaaacgtaacgttaaccgaaaaaccggtaacgtcgggtaacggcgttaacgacccgttacacgtttaccgttcgtttaccccg

SEQ ID NO: 354369 - DNA, 572 bp, Homo sapiens
  misc_feature: GZ8MTXP02JJZ84.13.8.A08.1.454.CMB.2.raw
  modified_base (256)..(256): a, c, t, g, unknown or other
  misc_feature (256)..(256): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcattgccgggcaagtcagaccattgaacaaatatagtaaattggtatcaaanagaagccaggtagaacgcccctaaagcctcctgatctatactgcatccactttgcgacgggccggggtaccatcccgtaaggttccgtagcaggtggatcgtagggacagtattcactctcaccatccgacagtctgacaacctgaacgtacctgtacgacctaaacttactacgttacgaccctaactacgttaccgttaaccggaacccttcgtaacttaccgtttacggaccgtaacgggtacccgaggtccgtacggagtactaccgaaaacgtaccgtaggtcggtctacgacgactactcgtcgtttacc

SEQ ID NO: 354370 - DNA, 619 bp, Homo sapiens
  misc_feature: GZ8MTXP02GAE1N.13.8.A08.1.454.CMB.2.raw
  modified_base (192)..(192): a, c, t, g, unknown or other
  misc_feature (192)..(192): n is a, c, g, or t
  modified_base (221)..(221): a, c, t, g, unknown or other
  misc_feature (221)..(221): n is a, c, g, or t
  modified_base (261)..(261): a, c, t, g, unknown or other
  misc_feature (261)..(261): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatcgacccagtctccatccctcctgtctgcatctgtagganacagagtccaccgtcacgttcggccgganaagtcacgtaccattgaacaatatagtaattgtatacaanagagccaggtacgacgacccctaagcctccgtgactactatactgctactccctatttggtcgacggggtccggtcccagtacccgtaacgggttccgtggacgtaggtggtatcggtagggaactagttactttaccactcctaccacctacttacccaacctacgttacctcgacctaaaccgttagaacgtacttagactacttaaaccttactacgacgacctaacgtacgtaccgttaccggtaacctaccggttaactacgtttcggaccgggtacgggaccgaggtaccgtagaaacgtactaaccgtaaacgtaccgtaggtcgtacgcgactactactcttacgttacc

SEQ ID NO: 354371 - DNA, 685 bp, Homo sapiens
  misc_feature: GZ8MTXP02INA90.13.8.A08.1.454.CMB.2.raw
  modified_base (191)..(191): a, c, t, g, unknown or other
  misc_feature (191)..(191): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccgtcacttgccgggcaagtcagacctattgaacaaatatagtaaattggtatcaaacagaagccaggtagaacgcccctaagctcctgtatctaatactgcactccctactttgtccgacggggtccggggtcccctagttcccgtaaacgggtttcccggtaggtacgtaggttagggacgttccgggttaggggaacctaaggttacttttacccaccttaccttaccgaacccaaattcccgaaccctaacgttacgttcgaaccctaaaccctacggtaaacgtacctaggtactactaaaccctttaactaccgtaccgacctaaactacgttaccgttaaccggtaaccttcgtaaccttacgttttacggaccggtaacggggaccgtacggtaccgtaggggtaaactaacgtaccgtaaaaaccggtaacgtcggtaacgggtacctacgacctacctaacgttctacgtttccc

SEQ ID NO: 354372 - DNA, 593 bp, Homo sapiens
  misc_feature: GZ8MTXP02HPCM6.13.8.A08.1.454.CMB.2.raw
  modified_base (190)..(190): a, c, t, g, unknown or other
  misc_feature (190)..(190): n is a, c, g, or t
  modified_base (260)..(260): a, c, t, g, unknown or other
  misc_feature (260)..(260): n is a, c, g, or t
  modified_base (354)..(354): a, c, t, g, unknown or other
  misc_feature (354)..(354): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccgtcacttggccgggacaagtcagaccattagaacaaatatagtaaattggtaatacaanagaacgccaggtagaacgcccctaagctcctgactctatactgactactcctactttgcgacggggtccgggtaccagtccgtaacggttccgnggacaggtggatcgtgggaactagtatttcactctaccacactacacacgtctcgtaccaacctagaaacgtacgtagtacactaaacctttactaactacgaacctaacgtacgttacgtaaccggtaaccttacgtaacgttaccgtttacggacccgtaacggggaccgacggtaccgtagaacggtaactaacgaaaccgtagtcgtaagcgtacgaccactactcttacgttcc

SEQ ID NO: 354373 - DNA, 731 bp, Homo sapiens
  misc_feature: GZ8MTXP02IPSU7.13.8.A08.1.454.CMB.2.raw
  modified_base (191)..(191): a, c, t, g, unknown or other
  misc_feature (191)..(191): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagacgtcaccgtcacgttggccgggacaagtcagacctattgacaaatatagtaaattggtatacaacagaagcaggtgaacgcccctaagctcctgactctaatactgctactccctaacttttgacgacggggtccggggtaccctagtaccccggaaacggggtttccgtcggacgtagggttacggtacgttccgggtaggggaactacggttacttttacccaccttacctacccaaccctactaccctaaccccgtagttacccgtaccgtaacctaaccccggtaggtaaaaccgtaccggttgtaaccggtaaccttaaacccgttttacctaccgttacgaaccccgtaaacttacccggtaccgtttaaacccgggtaaccctttacggtaaccctttaccggtttaccgggaccgttaacgggggaacctacgggtcgtaaccgggaaagtaaccgtaaaacgtaaaacggtaaccgtgggtaacgtactaccggtacctaaccgtacttcgggtttactttacccg

SEQ ID NO: 354374 - DNA, 592 bp, Homo sapiens
  misc_feature: GZ8MTXP02FUADC.13.8.A08.1.454.CMB.2.raw
  modified_base (263)..(263): a, c, t, g, unknown or other
  misc_feature (263)..(263): n is a, c, g, or t
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
  modified_base (356)..(356): a, c, t, g, unknown or other
  misc_feature (356)..(356): n is a, c, g, or t
  modified_base (561)..(561): a, c, t, g, unknown or other
  misc_feature (561)..(561): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtctccatcctcctgtctgcatcgtgtaggagacagagtcaccgtcacgttgccgggcaaggtcagacctattagaacaaatatagtaaattggtatacaaanagaagccaggtgaacgcccctaagctcctgatctatacngcatcctattgcgagggccggtccatccgacggttccgngactaggtgtatcgngggactagtactttcgacttcaccacactccactagtctagacccaactagaaacgtctacgtcacctaaactttaccgtaactaccgaccaaactagtacccgttaacggtaacccgttcgttacgtacgtttcgggaccgacggggaacctgggacgtagggaaactaacgtaacgtaaaacgtacgttacgggtcggtacgngtaacccctactactacggtttctttacccg

SEQ ID NO: 354375 - DNA, 621 bp, Homo sapiens
  misc_feature: GZ8MTXP02FVA81.13.8.A08.1.454.CMB.2.raw
  modified_base (96)..(96): a, c, t, g, unknown or other
  misc_feature (96)..(96): n is a, c, g, or t
  modified_base (217)..(217): a, c, t, g, unknown or other
  misc_feature (217)..(217): n is a, c, g, or t
  modified_base (343)..(343): a, c, t, g, unknown or other
  misc_feature (343)..(343): n is a, c, g, or t
  modified_base (416)..(416): a, c, t, g, unknown or other
  misc_feature (416)..(416): n is a, c, g, or t
tcagtcacgtactacacgaccggtgctcgatttagcatactctacaggggggagtcagtctcagtcaggacacagcatggacatgagggtccccgntcagctcctggggctcctgctactctggctccgaggtgccagatgtgacatccagatgacccagtctccatcctccctgtctgcatctgtaggagacagagtcaccgtcacttgccggganaagtcagaccattgaacaaatatagtaaattggtatacaacagaagccaggtgaagcccctaagcttcctgactctatactgctatcctatttgtacgacggcggggtcctatccgaaggttccgnggctaggtaggatcgtagggactagtattcactctcaaccatcacacgtctgacaaccgtgaagactacgganactaaccttactactacgaccaaactacgttaaccttaaccgggtaaacccttacgttaaccgttaacgttttccgggaccggtaacgggggtaacccgagggtaccgttaagggaacgtaaaccgtaaacgttaaaaaccggaaccttagggttaacgggcttaacggacccgtaaaccgttaacttcggtttaacgtttcccg

SEQ ID NO: 354376 - DNA, 604 bp, Homo sapiens
  misc_feature: GZ8MTXP02FTJ7K.13.8.A08.1.454.CMB.2.raw
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccgtcacttgccgggcaagtcagaccattgacaaatatagtaaattggtatcaaacagaagccaggtagaacgcccctaagctcctgatctatactgcatcctactttgcagggcggggtaccccagtcccgtaacgggttccgtggcgtaggtcggatcgtggggaactagtatttcactctcacatcactagtctgacaacctgaagactgtcgactaacttactactcgacccaaactacgttaccgttaaccggtaaccttcgttaacctacgttttacggaccggtaacggggaacccgagggtacgtagggaaacgtaacgtaaccgaaaacggtaaaccgttagggtaacggccgttacggacccaaaccctaacgttcccgtttacgtttaccg

SEQ ID NO: 354377 - DNA, 565 bp, Homo sapiens
  misc_feature: GZ8MTXP02HBCTT.13.8.A08.1.454.CMB.2.raw
  modified_base (269)..(269): a, c, t, g, unknown or other
  misc_feature (269)..(269): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtctccatcctccctgtctgcatctggtaggagacagagtcaccgtcacttggccgggcaaagtcagacctattagaacaaatatagtaaattggtatacaaacagaanaccgaggtagaacgcccctaagcctctgatctatactgacatcctactttgcaggggccggtccatccgaggttccgtgcngngactgtggganagtattcactctacaccatccactacgtctacgactaaccgagaaacgtactagtacgactaaacttaactactacgaccaactacgtaccgttaaccgtaccgtacgtactacgtttacggaccgtacggggtacgacggtacgaggacgtactaacgaaacgaactcggtaaggtccaggactacgacttctacgtttcc

SEQ ID NO: 354378 - DNA, 633 bp, Homo sapiens
  misc_feature: GZ8MTXP02FK394.13.8.A08.1.454.CMB.2.raw
  modified_base (192)..(192): a, c, t, g, unknown or other
  misc_feature (192)..(192): n is a, c, g, or t
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgctagatgtgacatccagatgacccagtcctccatccctcctgtctgcatctgtagganacagagtcaccgtnacttggccggnaagtcagaccattgaactaaatagtagtaaattggtaatacaaacagaacgccaggtgaacgcccctaagcctctgatctatactgcactcctactttgacgagggtccgggtcccagtccccgtaagggttcccgtggactaggtcgatcggtagggactagttactttcactcctaccaccatccactacgtactacgaccaaaccgtagaacgtactacgtacgtaactaaccttacgtactacgaccctaaacgtacgttaccgttaacccggacccgttaccgtaaccttacggtttcggacccgggtaacgggaccctaggggacctacgggtaacgtaacttaaccgaaaaccggtacgttacgggtaacggccttacggaccctaaccgtagttcctacgtttacccg

SEQ ID NO: 354379 - DNA, 553 bp, Homo sapiens
  misc_feature: GZ8MTXP02JUVEJ.13.8.A08.1.454.CMB.2.raw
  modified_base (191)..(191): a, c, t, g, unknown or other
  misc_feature (191)..(191): n is a, c, g, or t
  modified_base (339)..(339): a, c, t, g, unknown or other
  misc_feature (339)..(339): n is a, c, g, or t
  modified_base (371)..(371): a, c, t, g, unknown or other
  misc_feature (371)..(371): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtccaccgtcacttggccgggcaagtcagaccattgacaaatatagtaaattggtatcaaacagaagccaggtgaaacgcccctaagcctcctgatctatactgcactccatttgcagggccgggtcccatccgaggttccgngcagtgatcgtgggacagtattcactctcacntccacagtctgacacctagaacgctgtcgactaacttactactgacccaatcgttacttaaccggaccttacgtactacgtttcggaccgtaacggggaccagggtcgtacgggaacgtacgtaaccgaaaacgtaacgttggtaacggcttacggacctaccgacttaccgtcgtttaccc

SEQ ID NO: 354380 - DNA, 615 bp, Homo sapiens
  misc_feature: GZ8MTXP02IQSWZ.13.8.A08.1.454.CMB.2.raw
  modified_base (602)..(602): a, c, t, g, unknown or other
  misc_feature (602)..(602): n is a, c, g, or t
  modified_base (610)..(610): a, c, t, g, unknown or other
  misc_feature (610)..(610): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtctccactcctccctgtctgcatctgtaggagacagagtccaccgtcacttggccgggcaagtcacgacctagttagacaaatatagtaaagttaggtactacaacgagaacgaccgaggtacgaaccgcccctaaagccttacctgtacttacttaactacgtgactaccttcccgtactttgtaccgacggggtccggggtacctacgtaccgtaacggggttccgtggactaggtggactcggtagggactagtacttcactctacacgataccacgacgtctacgacaacccgtagaacgtactagtcgaaccttaacttaacacgttacgacctagtaaccgttcgttaaccggtaactcgttaacttcgtttaccggcgacggtacgcggtactgggaactacgaccgtaaaacgtgtagtgacgtgaccgtaancttacgtnttacc

SEQ ID NO: 354381 - DNA, 625 bp, Homo sapiens
  misc_feature: GZ8MTXP02G58RZ.13.8.A08.1.454.CMB.2.raw
  modified_base (222)..(222): a, c, t, g, unknown or other
  misc_feature (222)..(222): n is a, c, g, or t
  modified_base (610)..(610): a, c, t, g, unknown or other
  misc_feature (610)..(610): n is a, c, g, or t
tcagtcacgtactacacgaccggtgctcgatttagcatactctacagggggggagtcagtctcagtcaggacacagcatggacattagggtccccgctcagctcctggggctcctgctactctggctccgaggtgccagatgtgacatccagatgacccagtcctccatccctccctgtctgcatctgtaggagacagatccaccgtcacgttggccggganaagtcagaccattgaactaaatatagtaaattggtatacaaacagaacgccgaggtagaaaccgtcccctaagccctcgtagtacttcgtaatacctgacctaatccccttaacggttttcgaccggtacggggcccgggttaccccaagttaccgtaaccggggtttccgtaggcgttaggcggtacgtcgggtaggactagtcttacacctctacaccatccacgtatcgtagcctaacgtagaacgcgttgactaacttaacttacgtaacctacgacctaaacgtacgttaccgtaacccgtaaccttggttacttaccggttaggaccgaggggacctaggcgtagaacggtacaaccgaacgtatcggagctacgtcacgtnttaccgtcttactcg

SEQ ID NO: 354382 - DNA, 647 bp, Homo sapiens
  misc_feature: GZ8MTXP02FX346.13.8.A08.1.454.CMB.2.raw
  modified_base (193)..(193): a, c, t, g, unknown or other
  misc_feature (193)..(193): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatcgacccagtctccatcctccctgtctgcatctagtagganacagagtcaccgtctacgttcggccgggtacaagtcacgacctattagaactaaatatagtaaattaggtatacaacagaacgccaggtagaacgacccctaagcctctgattctaatacgtcactactcctactttgtccgaacggggtccgggtaccctagtccgtaacggttccgtggacgtagtccggatcggtacgggactagttacttccacctacctaccctaacctacgttacccaacgtacgtccctacgtaaccaaacccgttagaaacgtactaggtactaacctaaaccgtttactaccctacgaacccctaacgtacgttaccccgttaacggtaccttacgttaacgttcgtttacgacggtaacgggacgacggcgtagggtaacaacgtaaccgaaacgtgttaggcgtacgtcgactacctacgttcgtactttccc

SEQ ID NO: 354383 - DNA, 542 bp, Homo sapiens
  misc_feature: GZ8MTXP02FHO4R.13.8.A08.1.454.CMB.2.raw
  modified_base (206)..(206): a, c, t, g, unknown or other
  misc_feature (206)..(206): n is a, c, g, or t
  modified_base (217)..(217): a, c, t, g, unknown or other
  misc_feature (217)..(217): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
  modified_base (416)..(416): a, c, t, g, unknown or other
  misc_feature (416)..(416): n is a, c, g, or t
  modified_base (431)..(431): a, c, t, g, unknown or other
  misc_feature (431)..(431): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtnacttgccgggnaagtcagaccattgacaaatatagtaaattggtatcaacagaagcaggtagaacgcccctaagcctctgatctatactgcaatccgaactttgtcgagggcggggtccccagtcccgaaggttccgtggcagtcggatcgtgggacagattnacntcaccataccgaccagtctgacaaccgttagaaacgcttacggngtactaactactacncacactacgtacgttacgtacctacgtacgtacgttcgtacgaacgggacgacgcgtacgacgaacgtaccgaaacgtaacgtacgtcgtcgtacgtacactactctcgtc

SEQ ID NO: 354384 - DNA, 648 bp, Homo sapiens
  misc_feature: GZ8MTXP02FHK83.13.8.A08.1.454.CMB.2.raw
  modified_base (210)..(210): a, c, t, g, unknown or other
  misc_feature (210)..(210): n is a, c, g, or t
  modified_base (269)..(269): a, c, t, g, unknown or other
  misc_feature (269)..(269): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatcgacccagtctccatccctccctgtctgcatctgtaggagacagacgtccaccgtnacgttcggccgggacaagtcagacctattagaactaaatatagttaaattgtatacaanagaacgccgaggtacgaaccgacccctaagccttccgagactactatactgctactcctactttggacgtacggggccggtacccagtacccgtacgggtttccgaggactagggtcgtacttcggagggactagttactttaccacttcctaccaccatacccgaccgtagtactacgaccaaccgtagaacgtacgtcgactacctaaacttacgtactacgaaccctaacgtacgttaacccgttaaccggtaacccttacgttaacctacggtttaccgggaccggacggggtaccgaggtacggtacggaaactaacgtaacgaaaaccgtcgttaggcggactacggacctaacgtcttccgtacgtttaccc

SEQ ID NO: 354385 - DNA, 621 bp, Homo sapiens
  misc_feature: GZ8MTXP02FQFA4.13.8.A08.1.454.CMB.2.raw
  modified_base (193)..(193): a, c, t, g, unknown or other
  misc_feature (193)..(193): n is a, c, g, or t
  modified_base (198)..(198): a, c, t, g, unknown or other
  misc_feature (198)..(198): n is a, c, g, or t
  modified_base (218)..(218): a, c, t, g, unknown or other
  misc_feature (218)..(218): n is a, c, g, or t
  modified_base (268)..(268): a, c, t, g, unknown or other
  misc_feature (268)..(268): n is a, c, g, or t
  modified_base (286)..(286): a, c, t, g, unknown or other
  misc_feature (286)..(286): n is a, c, g, or t
  modified_base (298)..(298): a, c, t, g, unknown or other
  misc_feature (298)..(298): n is a, c, g, or t
tcagtcacgtactacacgaccggtgctcgatttagcatactctacagggggggagtcagtctcagtcaggacacagcatggacatgagggtccccgctcagctcctggggctcctgctactctggctccgaggtgccagatgtgacatccagatcgacccagtcctccatcctcctgtctgcatctgtagganacagngtccaccgtctacttggcgnggacacgcgacgactatacgaataatatagttaatgtacaacaagagacncgtagcaaccaccagtcnctagactatacntcgactacgtacttgttcgacggtcgggaccgttaccacgtaacggtaccggttgcgtacgtggacggttcacgggtaggaacttaccgttacttacgctacctacgactactacgaactctaccgttacaccgtacgtaaggactacggttcgtaaactacctaaacggtttaaccaccgtaacgaacgtaaccgttacccgtaacgttaaccgtacttaccggttacgtacgggtaccggacggaacgtacgaggtacggtaacgaaactacgaaacggtacgtcggtaacgtcgtacaccgtacctaacgtcgttacgtc

SEQ ID NO: 354386 - DNA, 755 bp, Homo sapiens
  misc_feature: GZ8MTXP02GAUQO.13.8.A08.1.454.CMB.2.raw
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
  modified_base (380)..(380): a, c, t, g, unknown or other
  misc_feature (380)..(380): n is a, c, g, or t
  modified_base (443)..(443): a, c, t, g, unknown or other
  misc_feature (443)..(443): n is a, c, g, or t
tcagtcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatccctcctgtctgcatctgtagganacagagtccaccgtcacttggccggnaagtcagacctntagactaatatagtaaattggatcaacagaagccgaggtcaacgcccctaagctcctagtactctatactgcaattccctacgtttgacgacggggtccgggtcctagtccgtaaacgggttccgtagggaccgtaggtacggacgttcgnggggtaaccaggttaactttccaactttccaccgtaaccctacttacccaccgtaacggttcncgtaacccaaccgttacggaaagttccgtacgttccgaaaaccgtttaaaccttaacccggttaacaccgtaaaccgtaaaaccgttacgttacccgtttaaaccggtaaaccctttaccgttaaaacgttccgggttttaaccggacccgggggttaaaccggggaaaccccgtaggggtttaaacccgacgggggtttaaaacgtaaccggtttaaacccggaaaacggttacccggtttaacggtaaccggttaacccgtaccgtaacccgtaaccggtttaacgtttcccggtttaccgtttaacccg

SEQ ID NO: 354387 - DNA, 605 bp, Homo sapiens
  misc_feature: GZ8MTXP02HZEJB.13.8.A08.1.454.CMB.2.raw
  modified_base (569)..(569): a, c, t, g, unknown or other
  misc_feature (569)..(569): n is a, c, g, or t
tcagtcacgtactacacgaccggtgctcgatttagcatactctacagggggggagtcagtctcagtcaggacacagcatggacatgagggtcccccgctcagctcctggggctcctgctactctggctccgaggtgccagatgtgacatccagatgacccagtctccatcctccctgtcctgcatctgtaggagacagatccaccgtcacttgccggcaagtcagaccattagaacaaatatagtaaattggaatacaacagaacgccaaggtagaaacgtcccctaagcctacctagtactctaatactgacctactcccgtaacttttcgaccggagggtacccggggtaccctaagtaccccgaaacgggtttcccgtaggacctaggtcggtatcgggtaggaactagtactttacgactctacacataccacctatctacgactaaccgagaagactggtactacgtaacttaacctagtccgaccaactacgtacgtaccgaacttcgtacttacgttacggacgaacggtacaggcgtagacgtaactaccgaaacgtacgnggtaacgctaacgacctaaccgtactcgttacgtcc

SEQ ID NO: 354388 - DNA, 578 bp, Homo sapiens
  misc_feature: GZ8MTXP01EML67.44.7.A07.1.454.CMB.2.raw
  modified_base (224)..(224): a, c, t, g, unknown or other
  misc_feature (224)..(224): n is a, c, g, or t
  modified_base (322)..(322): a, c, t, g, unknown or other
  misc_feature (322)..(322): n is a, c, g, or t
  modified_base (347)..(347): a, c, t, g, unknown or other
  misc_feature (347)..(347): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcaccctggacagtcgcctcatctcctgcacgtctgatcggagcctnttacatactaatgggaagacttatttgtattggtacctacagaggccaggccagtcgccgcagctcctagtccagcaaggttccagccgtcttttcgnggtacgtgtacagacaggaactcgnggtcggccgtccggctacgaagaaactagtacttacactactagaacaatacgacgccggcggtagggacggcgtggcggaggtggtcgttggttagtttattacgtgtcgttgacgtaagtacgtttacggtaccggttaacgttacgtttcgggaccggttacggggtacccggtcgttacgggttacggttacgtaacgtacgtaacgtggtcggcgtcgcgtaaccg

SEQ ID NO: 354389 - DNA, 508 bp, Homo sapiens
  misc_feature: GZ8MTXP01DHO57.44.7.A07.1.454.CMB.2.raw
  modified_base (324)..(324): a, c, t, g, unknown or other
  misc_feature (324)..(324): n is a, c, g, or t
  modified_base (344)..(344): a, c, t, g, unknown or other
  misc_feature (344)..(344): n is a, c, g, or t
  modified_base (392)..(392): a, c, t, g, unknown or other
  misc_feature (392)..(392): n is a, c, g, or t
  modified_base (473)..(473): a, c, t, g, unknown or other
  misc_feature (473)..(473): n is a, c, g, or t
  modified_base (479)..(479): a, c, t, g, unknown or other
  misc_feature (479)..(479): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggagcctcttacatactaatgggaagacttatttgattggtacctacagaggccaggccagtcgccgcagctcctagtccagcaaggttccagccgtcttttcgnggagtgtcagacaggaatcngtcggctccggctacagaaacagtatttcacactgacaatcagcgcgnggagctgcggagtgcgtggttgtttattacgtgcttgctaagtcttagaccgttaactacgtttggccgaggggtacccgngttggngttcaagtcgaacgtgtggctgctaaccg

SEQ ID NO: 354390 - DNA, 562 bp, Homo sapiens
  misc_feature: GZ8MTXP01EVQ6D.44.7.A07.1.454.CMB.2.raw
  modified_base (222)..(222): a, c, t, g, unknown or other
  misc_feature (222)..(222): n is a, c, g, or t
  modified_base (245)..(245): a, c, t, g, unknown or other
  misc_feature (245)..(245): n is a, c, g, or t
  modified_base (267)..(267): a, c, t, g, unknown or other
  misc_feature (267)..(267): n is a, c, g, or t
  modified_base (394)..(394): a, c, t, g, unknown or other
  misc_feature (394)..(394): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcacccctggacagtcgcctccatctcctgcacgtctgatcggancctcttacatactaagtgggaanacttatttgtattggtacctanagaggccaggccagtcgccgcagctcctagtccagcaaggttccagtccgtcttttcgtggacgtgtacagacaggaactcgaaggtcggctcccgggctacaaggaaacagtatttacactactanaacaatacgacgccgcggtggacgcgtagcggaggtggtcgttggttagtttattacgtgtcgttgcgtaagtcgttacgaccggttaactacgttttcggccggacggggacccggtcggttagggcggttacgaacgtcgtaacgtggtacggcttcgcgtaaccg

SEQ ID NO: 354391 - DNA, 593 bp, Homo sapiens
  misc_feature: GZ8MTXP01BCU2D.44.7.A07.1.454.CMB.2.raw
  modified_base (328)..(328): a, c, t, g, unknown or other
  misc_feature (328)..(328): n is a, c, g, or t
  modified_base (351)..(351): a, c, t, g, unknown or other
  misc_feature (351)..(351): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcacccctggacagtcgcctccatctcctgcacgtctgatcggagcctcttacataactaatgggaagtacttatttgtattggtacctacagaggccaggccagtcgccgcagctcctagtccagcaaaggttccagtcccgtcttttcnggtagtgtacagacaggaatcgngtggctccggctacaagaaacagtatttacactactgaacaatacgacgccgcggtgggagcgtggcggtagtgtcgttggttgtttaattaccgttgtcgttagtcgtaaacgtcgtttaacggaccggttaacgttaacggttttcgggacccggttacgggggaacccgggtcgttacggggttacgggttactaaacggtccgtaaccgttgggtggttccgtcggttccgtaacccg

SEQ ID NO: 354392 - DNA, 657 bp, Homo sapiens
  misc_feature: GZ8MTXP01B2GSN.44.7.A07.1.454.CMB.2.raw
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (261)..(261): a, c, t, g, unknown or other
  misc_feature (261)..(261): n is a, c, g, or t
  modified_base (279)..(279): a, c, t, g, unknown or other
  misc_feature (279)..(279): n is a, c, g, or t
  modified_base (317)..(317): a, c, t, g, unknown or other
  misc_feature (317)..(317): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatcctggattgagtgcggatattgtggtgacccagactccactctctctgtctgtccaccctggacagtcgcctcatctctgcacgtctgatcggancctntacatactaagtgggaatacttattgattggtacctanagaggcaggcagtcgccnagctcctagtccagctaaggttccagtccgtctttcgnggacttgtacaggacaggtaaatcgaaggtcgggccttcccgggctacgaaaggaaactagtactttacaacactacgaactaatcgaacgccgcggtaggacggtccgtaggaccggtaggtcggtcgtttagggtttacgttttaacgttaacgttcggttaccgtttagtaccgtaaacggttaccgttttaaacgggtaaccccggtttaacgttaaccggtttttaccgggggacccggttaccggggggtaaaccccggtcgggttacggggacgggttaccgtaaagttaccggtaaacgttcgggttacgggcgttcggaaccgttaacccg

SEQ ID NO: 354393 - DNA, 590 bp, Homo sapiens
  misc_feature: GZ8MTXP01EPJ3H.44.7.A07.1.454.CMB.2.raw
  modified_base (328)..(328): a, c, t, g, unknown or other
  misc_feature (328)..(328): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtccacccctggacagtcggcctccatcctcctgcacgtctgatcggagcctcttacatactaagtgggaatacttatttgattggtacctacgagaggccaggccagtcgccgcagctccagtccagcaaggttccagtccgtcttttcgnggacgtgtacagacaggaatcgaaggtcggccgtccgggctacgaacgaaactagtactttacacactagaacaactacacgccgcggtggacggcgtggacggtagtcggtcgttggttagtttattacgtgtacttgactaagttacgtttacggtaaccggttaactacgttttcgggaccggttaccggggtaccggtcggttggggttacgttaccgtaagtcggtaaacgttgggtcggttcgtcggccgtaaccg

SEQ ID NO: 354394 - DNA, 575 bp, Homo sapiens
  misc_feature: GZ8MTXP01ASBJ8.44.7.A07.1.454.CMB.2.raw
  modified_base (326)..(326): a, c, t, g, unknown or other
  misc_feature (326)..(326): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggagcctcttacatactaagtgggaagtacttatttgtattggtacctacgagacggccaggccagtcgccgcagcctcctagtccagcaacggttccagtcccgtntttcgtggtacgtgtcagtacaggtaatcgaagtcggcgtccgggctacgagaaactgtactttacactactgaacaatacgacgccgcggtggagctggcgagtgcgttggttgtttaatcgtgtcgttgacgtaagtcgtttacggtacccggttaacgtcgttttacgggccggttacgggggtaccccggtcggttacggggacggttacgtaacgtcggaacgtggtcggcgttcggctaaccg

SEQ ID NO: 354395 - DNA, 542 bp, Homo sapiens
  misc_feature: GZ8MTXP01AFH49.44.7.A07.1.454.CMB.2.raw
  modified_base (328)..(328): a, c, t, g, unknown or other
  misc_feature (328)..(328): n is a, c, g, or t
  modified_base (355)..(355): a, c, t, g, unknown or other
  misc_feature (355)..(355): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcacccctggacagtcgcctcatctcctgcacgtctgatcggagcctcttacatactaagtgggaatacttatttgtattggtacctacagaggccaggccagtcgccgcacgctcctagtccagcaacggttccacgtccgtcttttcgnggtacgtggtcaagtacaggtaatcgnggtcgggcctccgggctacgaagaaacagtactttacactactagaacaatacacgccgcgtggagcgtgcgagtgtcgttggtgtttatcgtgtcgtgactagtcttacggcgtaactcgtttcggccgacggggacccggtgttgggcgttacgaagtcgaacgtcggtacggctcgcctaaccg

SEQ ID NO: 354396 - DNA, 578 bp, Homo sapiens
  misc_feature: GZ8MTXP01AY125.44.7.A07.1.454.CMB.2.raw
  modified_base (325)..(325): a, c, t, g, unknown or other
  misc_feature (325)..(325): n is a, c, g, or t
  modified_base (332)..(332): a, c, t, g, unknown or other
  misc_feature (332)..(332): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtccaccctggacagtcgcctcatctctgcacgtctgatcggagtccttacttacatactaagtgggaatacttattgtattcggtacctacgagacggccaggccagtccgccgcagcctctagtccagcctaaggttccagtccgtnttttcgnggtacgtgtcagacgaggaactcgaagtcggctcccgggctacgaagaaactagtacttcaactactacgacaataccgacgccgtcggtaggacgcgtagggcggtagtcggtcgttggttacgtttattaccgtgtcgtttagccgtaaagtccgtttaacggccggttaactacgtttcggaccggttacgggggacccgtcgttagggcgttacgaagtcgaacgttggcgcgtcgctaacg

SEQ ID NO: 354397 - DNA, 535 bp, Homo sapiens
  misc_feature: GZ8MTXP01BB5SA.44.7.A07.1.454.CMB.2.raw
  modified_base (318)..(318): a, c, t, g, unknown or other
  misc_feature (318)..(318): n is a, c, g, or t
  modified_base (324)..(324): a, c, t, g, unknown or other
  misc_feature (324)..(324): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcacccctggacagtcgcctcatctcctgcacgtctgatcggagcctcttacatactaagtgggaagtacttatttgtattggtacctacagaggccaggccagtcgccgcagctcctagtccagcaaggttccagtcctntttcgnggacgtgtcagacaggaatcgaagtcggcctcccgggctacgaagaaacagtatttacacactagaacaatcgacgccgcgtggagctgcggagtgcgttggtagtttatgtgtcttgctaagtcgttagccggtaactacgtttcggccgacggggacccgtgttacggcggttacgtaacgtcgaacgtgggtcggttctcgcgtaacc

SEQ ID NO: 354398 - DNA, 502 bp, Homo sapiens
  misc_feature: GZ8MTXP01C5NFR.44.7.A07.1.454.CMB.2.raw
  modified_base (227)..(227): a, c, t, g, unknown or other
  misc_feature (227)..(227): n is a, c, g, or t
  modified_base (245)..(245): a, c, t, g, unknown or other
  misc_feature (245)..(245): n is a, c, g, or t
  modified_base (265)..(265): a, c, t, g, unknown or other
  misc_feature (265)..(265): n is a, c, g, or t
  modified_base (322)..(322): a, c, t, g, unknown or other
  misc_feature (322)..(322): n is a, c, g, or t
  modified_base (365)..(365): a, c, t, g, unknown or other
  misc_feature (365)..(365): n is a, c, g, or t
  modified_base (474)..(474): a, c, t, g, unknown or other
  misc_feature (474)..(474): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggagcctnttacatactaatgggaanacttattgattggtacctanagaggccaggcagtcgccgcagctcctagtcccagcaaggttccagtccgcttttcnggactgtcagacaggaatcaaggtgctccgggctcaagaaacngatttcacactgacaatacagcgcgtggaggctgcggagtgctggttgttattactgcttgctaagtcttagcggtaactacttttggccgaggggacccgcgttcggnggttacaatcgaactgtggctcgcaacc

SEQ ID NO: 354399 - DNA, 573 bp, Homo sapiens
  misc_feature: GZ8MTXP01AXUFZ.44.7.A07.1.454.CMB.2.raw
  modified_base (289)..(289): a, c, t, g, unknown or other
  misc_feature (289)..(289): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (372)..(372): a, c, t, g, unknown or other
  misc_feature (372)..(372): n is a, c, g, or t
  modified_base (412)..(412): a, c, t, g, unknown or other
  misc_feature (412)..(412): n is a, c, g, or t
tcagacagtatatacacgaccggtgctcgatttagcacgtgtcgcagggggaccaggacttctcagttcatcttctcaccatgaggctccctgctcagctccgtggggctgctaatgctctggatccctggattgagtgcggatattgtggtgacccagactccactctctctgtctgtccaccctggacagtcgcctccatctcctgcacgtctgatcggagtcctcttacatactaatggggaatacttatttgattggtacctacagaggccaggccagtcgccgnagctctagtacagcaaggttccagcctntttcnggtagtcgtcagacaggtaatcaaggtggcctccgggctacgaagaaacngtactttcacactcgaacaatacgagccgcgtgggagcgngcggagtgtcgttgggttagtttattaccgtgtcgttagctaaagtctttaacggaccggttaactcggttttcgggacccgttacgggggtaaccccgtcggttaggggttcggttacgaaagtcggtaaacgtcggtgggccgttcggccgttaacccg

SEQ ID NO: 354400 - DNA, 646 bp, Homo sapiens
  misc_feature: GZ8MTXP01BPSLX.44.7.A07.1.454.CMB.2.raw
  modified_base (220)..(220): a, c, t, g, unknown or other
  misc_feature (220)..(220): n is a, c, g, or t
  modified_base (288)..(288): a, c, t, g, unknown or other
  misc_feature (288)..(288): n is a, c, g, or t
  modified_base (333)..(333): a, c, t, g, unknown or other
  misc_feature (333)..(333): n is a, c, g, or t
  modified_base (360)..(360): a, c, t, g, unknown or other
  misc_feature (360)..(360): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccatctctctgtctgtccaccctggacagtcgcctccatctctgcacgtctgatcgganccttcttacattactaagtgggaatacttattgtattggtacctacagaggccaggccagtccgccgnacgtctacctagtccagctaacgggttccaggtccgtcttttcgnggtacgttgtcaggacagggaactcgnggtggccctccgggctaccgaaggaaaactgtatttacaactactagaacaatacgacgaccgcggtaggacggcgtggacggagtcggtacgtttgggttacgttttaacgttacgttcggttcgtttacgtaccgtaaacggttacgtttaaccgggtaacccggtttaacgttaacggttttccgggacccgggttacgggggaccccgggtcggttacggggttacggttacgtaaacgttaccggtaagtttcgggcggttacgtcggttaacctaacccg

SEQ ID NO: 354401 - DNA, 589 bp, Homo sapiens
  misc_feature: GZ8MTXP01BFBMY.44.7.A07.1.454.CMB.2.raw
  modified_base (329)..(329): a, c, t, g, unknown or other
  misc_feature (329)..(329): n is a, c, g, or t
  modified_base (355)..(355): a, c, t, g, unknown or other
  misc_feature (355)..(355): n is a, c, g, or t
  modified_base (383)..(383): a, c, t, g, unknown or other
  misc_feature (383)..(383): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtccaccctggacagtcgcctcatctcctgcacgtctgatcggatcctcttacatactaagtgggaaatacttatttgtagttggtacctacgagaggccaggccagtcgccgcagcctcctagtccagcaaggttccagtccgtcttttcgnggtacgtgtacagtacaggaactcgnggtcgccgtccggctacgaagtaaaccngtacttacacactagaacaagtacgacgccgcggtggacgcgtaggcggtagtgtcgttggttagtttatacgtcgtacgttagtaacgtcgtttacgtaccggttactaacggtttcggaccggtacggggcccggtaggtacgggttacggttcgttaacgtaaccggtaacgtggtacggtcgttacggtccttaaccgtaac

SEQ ID NO: 354402 - DNA, 699 bp, Homo sapiens
  misc_feature: GZ8MTXP01BAYYL.44.7.A07.1.454.CMB.2.raw
  modified_base (408)..(408): a, c, t, g, unknown or other
  misc_feature (408)..(408): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtcgacccagacctccactctctctgtctgtccaccccgtggacagtccggcctccatcctcctgccacgtctgatcggacgtcccttacttaacattaactaagtaggggtaacttactttattgtattacggtacctacgagacggccgacggcccaggtccggcccgacacgtcctaccgtacgtacccacgaccgtaacggttccgacgttcccgttcgttttcgtaggtacgttcgacagacgaggtaactcgnggtcggtacccgtcggactaacaacggaaactacgtactttacgaacctacgtacgaaacctaagtacccgacgggtaccccggtagggtacgggaacggtcgtacggggtacggtcgttcggttcggtttaagttcgttttaacgttcgtacgtcgttaaggtctaacgtttccggttaaaccggtcccggttaacttcgggtttccggggacccggttacgggggtacccggtggttacgggcgttaaccgaagtacggtaaccgtggtcggttacctcgttcctaacg

SEQ ID NO: 354403 - DNA, 554 bp, Homo sapiens
  misc_feature: GZ8MTXP02ILK35.44.7.A07.1.454.CMB.2.raw
  modified_base (222)..(222): a, c, t, g, unknown or other
  misc_feature (222)..(222): n is a, c, g, or t
  modified_base (323)..(323): a, c, t, g, unknown or other
  misc_feature (323)..(323): n is a, c, g, or t
  modified_base (353)..(353): a, c, t, g, unknown or other
  misc_feature (353)..(353): n is a, c, g, or t
  modified_base (365)..(365): a, c, t, g, unknown or other
  misc_feature (365)..(365): n is a, c, g, or t
  modified_base (377)..(377): a, c, t, g, unknown or other
  misc_feature (377)..(377): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcaccctggacagtcggcctccatctcctgcacgtctgatcggancctcttacatactaatggaatacttattgtattggtacctacagaggccaggccagtcgccgcagctcctagtccagcaaaggttccagccgtcttttcgnggagtgtcagacaggatcagtggctccggntacgagaaaacngattcacactanacaatacacgcgcgtaggagcgtgcggagtgtcgttggttagtttagttacgttcgtcgttcgtacgtaacgtacgtttacgtaaccggttacgttacgtttacggtaccggtacggggtaccggtacgtacggtacggtacgtaacgtacgtaacgtacgtcggtcgtcgacgacg

SEQ ID NO: 354404 - DNA, 537 bp, Homo sapiens
  misc_feature: GZ8MTXP02HCAHF.44.7.A07.1.454.CMB.2.raw
  modified_base (323)..(323): a, c, t, g, unknown or other
  misc_feature (323)..(323): n is a, c, g, or t
  modified_base (368)..(368): a, c, t, g, unknown or other
  misc_feature (368)..(368): n is a, c, g, or t
  modified_base (395)..(395): a, c, t, g, unknown or other
  misc_feature (395)..(395): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggagcctcttacatactaatgggaatacttatttgtattggtacctacagaggccaggccagtcgccgcagctctagtccagcaaggttccagccgtctttcgnggacgtgtcagacaggatcaggtcggctccggctacaagaaaacngtattcaactactgaacaatcagccgngtggagctgcgatgctggtagtttatacgtgcttgctaagtctttaagacccggttactacgttttcggacccgtagggggaccccgtgtacgggacggttacaagttccggaaacgttggtacggtctacggacgtaaccg

SEQ ID NO: 354405 - DNA, 518 bp, Homo sapiens
  misc_feature: GZ8MTXP02FO8FU.44.7.A07.1.454.CMB.2.raw
  modified_base (245)..(245): a, c, t, g, unknown or other
  misc_feature (245)..(245): n is a, c, g, or t
  modified_base (323)..(323): a, c, t, g, unknown or other
  misc_feature (323)..(323): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (384)..(384): a, c, t, g, unknown or other
  misc_feature (384)..(384): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggagcctcttacatactaatgggaanacttatttgtattggtacctacagaggccaggccagtcgccgcagctcctagtacagcaaggttccagccgcttttcnggacgtgtcagacaggatcngtgctcggctcagaaacngattcacactgacaatcagccgngtggagctgcggatgctggtgtttatactgtcttgctaagtctttacgaccggttactacgttttggcccgtagggggaccccggtgtacgggagttacgaagttcggaaacttggtcgggctacggctaaccg

SEQ ID NO: 354406 - DNA, 497 bp, Homo sapiens
  misc_feature: GZ8MTXP02J0352.44.7.A07.1.454.CMB.2.raw
  modified_base (245)..(245): a, c, t, g, unknown or other
  misc_feature (245)..(245): n is a, c, g, or t
  modified_base (324)..(324): a, c, t, g, unknown or other
  misc_feature (324)..(324): n is a, c, g, or t
  modified_base (410)..(410): a, c, t, g, unknown or other
  misc_feature (410)..(410): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcacccctggacagtcagcctccatctcctgcacgtctgatcggagcctcttacatactaatgggaanacttattgtattggtacctacagaggccaggccagtcgccgcagctcctagtccagcaaggttccagcccgtcttttcnggagtgtcagacaggatcgagtcggctccggctacagaaacagatttcacactgacatcagccgcgtggagctgcggatgctggtntttatacgtgcttgctagtcttagaccgtactacgtttcggaccgtacggggacccgtcgtggagtcaagtcgaactgtcggctgcc

SEQ ID NO: 354407 - DNA, 568 bp, Homo sapiens
  misc_feature: GZ8MTXP02GOVWO.44.7.A07.1.454.CMB.2.raw
  modified_base (222)..(222): a, c, t, g, unknown or other
  misc_feature (222)..(222): n is a, c, g, or t
  modified_base (325)..(325): a, c, t, g, unknown or other
  misc_feature (325)..(325): n is a, c, g, or t
  modified_base (340)..(340): a, c, t, g, unknown or other
  misc_feature (340)..(340): n is a, c, g, or t
  modified_base (343)..(343): a, c, t, g, unknown or other
  misc_feature (343)..(343): n is a, c, g, or t
  modified_base (365)..(365): a, c, t, g, unknown or other
  misc_feature (365)..(365): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcacccctggacagtcgcctccatctcctgcacgtctgatcggancctcttacatactaagtggggaatactttattgtattggtacctacagaggccaggccagtcgccgcagctcctagtccagcaaggttccagccgtctttcgnggatgtcagacaggntcngtcggctcggctcgaagaaacngtattacaacactagaacaatcacgccgcggtaggacggcgtgcggagtggtcgtgggttagtttagttacgttgtctttgacgtaagtacgtttacggtaaccggttactacggttttacggaccggtacgggggaccccggtcgtacgggtacggtacgtaaacgttcggaaacgttgggtacggtcgtcggactaacccg

SEQ ID NO: 354408 - DNA, 637 bp, Homo sapiens
  misc_feature: GZ8MTXP02G4TY9.44.7.A07.1.454.CMB.2.raw
  modified_base (221)..(221): a, c, t, g, unknown or other
  misc_feature (221)..(221): n is a, c, g, or t
  modified_base (323)..(323): a, c, t, g, unknown or other
  misc_feature (323)..(323): n is a, c, g, or t
  modified_base (348)..(348): a, c, t, g, unknown or other
  misc_feature (348)..(348): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcaccctggacagtcggcctcatctcctgcacgtctgatcggancctcttacatactaatgggaatacttattgtattggtacctacagaggccaggccagtcgccgcagctcctagtacagcaaggttccagccgtcttttcggnggtacgtcgtacagacgaggatcgnggtcgctccggctacgaaagaaactagtacttacacactagaactaactacgacgccgtacggtagggacgtcgtaggacggtagtcggtcgtttagggtttacgttttaacgttaccgttcggttacgttagtacgtaaggttaccgttttaaacgggtaacccggtttaacgttaccggttttaccggggacccgggtaaccgggggtacccggtacggttacggggtacggttaacgtaaacgttaccggtaaacgttcgggtacggtaccgtacggacctaaccg

SEQ ID NO: 354409 - DNA, 590 bp, Homo sapiens
  misc_feature: GZ8MTXP02H4QYQ.44.7.A07.1.454.CMB.2.raw
  modified_base (323)..(323): a, c, t, g, unknown or other
  misc_feature (323)..(323): n is a, c, g, or t
  modified_base (356)..(356): a, c, t, g, unknown or other
  misc_feature (356)..(356): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcaccctgacagtcggcctccatctcctgcacgtctgatcggagcctcttacatactaatggaatacttattgtattggtacctacagaggccaggccacgtcgccgcagcctctagtccagcaaaggttccagccgtcttttcgnggacgtgtcagacaggatcagtggcttcccggntacaagaaaccagtattcacactgaacaatcagccgacgtggagctggcgatgcgttggtagtttatacgtgtctttgactaacgtacgtttacgaaccggttacgtaaccgtttttcggggacccgtaaacggggggaccccggtacggttacggggtaacgggttaccgtaaaacggttaccggtaaaacggtttcgggttacgggtaccgtttcgggaacccttaacccgg

SEQ ID NO: 354410 - DNA, 496 bp, Homo sapiens
  misc_feature: GZ8MTXP02HZ77P.44.7.A07.1.454.CMB.2.raw
  modified_base (323)..(323): a, c, t, g, unknown or other
  misc_feature (323)..(323): n is a, c, g, or t
  modified_base (342)..(342): a, c, t, g, unknown or other
  misc_feature (342)..(342): n is a, c, g, or t
  modified_base (365)..(365): a, c, t, g, unknown or other
  misc_feature (365)..(365): n is a, c, g, or t
  modified_base (394)..(394): a, c, t, g, unknown or other
  misc_feature (394)..(394): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcaccctggacagtcggcctccatctcctgcacgtctgatcggagcctcttacatactaatgggaatacttatttgtattggtacctacagaggccaggccagtcgccgcagctcctagtccagcaaggttccagccgtcttttcnggagtgtcagacaggatcngtggctccgggctcgagaaaacngattcacactgacaatcagcgcgtggagntgcgatgctggtgttatactgcttgcaagtcttagaccgtactacgttttggccgtacggggacccgtcgtggtacggtcaagtcgaacgtgtgctgctacc

SEQ ID NO: 354411 - DNA, 560 bp, Homo sapiens
  misc_feature: GZ8MTXP02JP4XQ.44.7.A07.1.454.CMB.2.raw
  modified_base (317)..(317): a, c, t, g, unknown or other
  misc_feature (317)..(317): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (359)..(359): a, c, t, g, unknown or other
  misc_feature (359)..(359): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcaccctggacagtcgcctcatctcctgcacgtctgatcggagcctcttacatactaatggaatacttattgtattggacctacagagccaggccagtccgccgcagctcctagtccagcaaggttccagccgtctttcnggacgtgtcagacnggatcngtgcttccggctcgaagaaacngtattcacactgaacaatcgacgccgcgtgggacggcgtacggcggagtcggacgttgggttagtttattacgtgtcttacgacgtaagttcgtttaacggaccggttaacgtacgttttcgggacccggtacgggggtacccgtcggtacgggacggttaccgaacgtccggtaacgtcggtcggtctacggactaaccg

SEQ ID NO: 354412 - DNA, 534 bp, Homo sapiens
  misc_feature: GZ8MTXP02GQFX7.44.7.A07.1.454.CMB.2.raw
  modified_base (266)..(266): a, c, t, g, unknown or other
  misc_feature (266)..(266): n is a, c, g, or t
  modified_base (320)..(320): a, c, t, g, unknown or other
  misc_feature (320)..(320): n is a, c, g, or t
  modified_base (377)..(377): a, c, t, g, unknown or other
  misc_feature (377)..(377): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcacccctggacagtcgcctccatctcctgcacgtctgatcggagcctcttacatactaagtgggaatacttattgtattggtacctanagagccaggccagtccgccgcagctcctagtccagcctaaaggttccagccgtnttttcgtggacgttgtacagacaggacttcgaggtggcctccggctacgaagaaacngtaacttcaacactagactaatcacgccgcgtggagctggcgagtgcgttgggtagtttatacgtgtacttgactaagtcgtttagaccggttattcgtttggccgtaacggggcccgtgtacggagtacgaacgtcgtaacgtgtcggctcgcacg

SEQ ID NO: 354413 - DNA, 504 bp, Homo sapiens
  misc_feature: GZ8MTXP02JQMP8.44.7.A07.1.454.CMB.2.raw
  modified_base (245)..(245): a, c, t, g, unknown or other
  misc_feature (245)..(245): n is a, c, g, or t
  modified_base (320)..(320): a, c, t, g, unknown or other
  misc_feature (320)..(320): n is a, c, g, or t
  modified_base (339)..(339): a, c, t, g, unknown or other
  misc_feature (339)..(339): n is a, c, g, or t
  modified_base (359)..(359): a, c, t, g, unknown or other
  misc_feature (359)..(359): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggagcctcttacatactaatgggaanacttattgtattggtacctacagaggccaggccagtcgcgcagctctagtccagcaaggttccagccgtctttcnggactgtcagacaggatcngtggctccggctcagaaacngattcacactgacaatcagcgcgtggagctgcggatgcgtggtgtttattactgcttgcaagtcttagaccggttactacgttttcggccgtacgggggacccggcgtcgggaggttaccaagtcgaacgtgtcggctcgcaccg

SEQ ID NO: 354414 - DNA, 534 bp, Homo sapiens
  misc_feature: GZ8MTXP02ISU8W.44.7.A07.1.454.CMB.2.raw
  modified_base (223)..(223): a, c, t, g, unknown or other
  misc_feature (223)..(223): n is a, c, g, or t
  modified_base (266)..(266): a, c, t, g, unknown or other
  misc_feature (266)..(266): n is a, c, g, or t
  modified_base (320)..(320): a, c, t, g, unknown or other
  misc_feature (320)..(320): n is a, c, g, or t
  modified_base (340)..(340): a, c, t, g, unknown or other
  misc_feature (340)..(340): n is a, c, g, or t
  modified_base (361)..(361): a, c, t, g, unknown or other
  misc_feature (361)..(361): n is a, c, g, or t
  modified_base (494)..(494): a, c, t, g, unknown or other
  misc_feature (494)..(494): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcacccctggacagtcgcctccatctcctgcacgtctgatcggacncctcttacatactaatgggaatacttattgtattggtacctanagagcaggccagtcgcgcagctcctagtccagcaaggttccagccgtctttcgnggactgtcagacaggatcgngtcgctccggctcaagaaacngtacttcacactagaacaatcgacgccgcggtaggaggccgtggcggtatcgtcgtggttcgtttaattacgtgtcttggactaagtactttacgaccggttacttacgtttcggaccggtacggggacccgngtacgggacggtcaagtcgaacgtggtcgcgtcgcaaccg

SEQ ID NO: 354415 - DNA, 666 bp, Homo sapiens
  misc_feature: GZ8MTXP02HMUCO.44.7.A07.1.454.CMB.2.raw
  modified_base (272)..(272): a, c, t, g, unknown or other
  misc_feature (272)..(272): n is a, c, g, or t
tcagacagtatatacacgaccggtgctcgatttagcacgtgtcgcagggggaccaggacttgtcagttcatcttctcaccatgaggctccctgctcagctcctggggctgctaatgctctggatccctggattgagtgcggatattgtggtgacccagactccactctctctgtctgtccaccctggacagtcgcctcatctcctgcacgtctgatcggacgtcctcttaacattactaaagtgggaagtacttatttgtattggtacctanagagccaggccagtcgcgcagcctctagtccagactaacggttccacgtcccgtcttttcgtggtacgttcgtacaggacagggtactcgaggtcggtcctccgggacttacgaaacgaaactagtactttacaactacgtagaactaatacgaaccggccggtacggtagggacggcgttacgggaccggtaagttcggttaccgttgggtttacgttttaacgtttaccgtggttacgttacgtacgtaaacgttcgtttaacgtaacccggtttaacgtttacggtttttacgggacccgggtacgggggtacccgggtacggttacgggtacggttacgtaaacgttaccggtaaacgttcggtacggtccgttacggtaccgttaaccg

SEQ ID NO: 354416 - DNA, 518 bp, Homo sapiens
  misc_feature: GZ8MTXP02JZCL3.44.7.A07.1.454.CMB.2.raw
  modified_base (246)..(246): a, c, t, g, unknown or other
  misc_feature (246)..(246): n is a, c, g, or t
  modified_base (368)..(368): a, c, t, g, unknown or other
  misc_feature (368)..(368): n is a, c, g, or t
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtccacccctggacagtcggcctccatctcctgcacgtctgatcggagcctcttacatactaatgggaanacttattgtattggtacctacagaggccaggccagtcgccgcagctcctagtccagcaaaggttccagccgtctttcgtggacgtgtcagacaggatcgagtggctccggctacaagaaacngactttcacactagacaatcacgccgngtggagctggcgangcgtggttgtttatactgtctgactagtcttagaccgttactacgtttcggaccggacggggaccgcgtacgggacgtacgaacgtcgtaagtcggtcgctcgactacc

SEQ ID NO: 354417 - DNA, 568 bp, Homo sapiens
  misc_feature: GZ8MTXP02H0F6A.44.7.A07.1.454.CMB.2.raw
  modified_base (220)..(220): a, c, t, g, unknown or other
  misc_feature (220)..(220): n is a, c, g, or t
  modified_base (324)..(324): a, c, t, g, unknown or other
  misc_feature (324)..(324): n is a, c, g, or t
  modified_base (412)..(412): a, c, t, g, unknown or other
  misc_feature (412)..(412): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcaccctggacagtcgcctcatctcctgcacgtctgatcggancctcttacatactaagtgggaatacttattgtattggtacctacagaggccaggccagtccgcgcagctcctagtccagcaaggttccaggtcccgtctttcgnggtacgtgtacaggacagggtacttcgaggtcggccttccgggctaccgagaaaacctgtacttcacactagaacaatacacgcgcgnggagcgtaggcgatcgtcgtggttgtttacttacgtgtcgttgactaagtctttacggtacggtacgttacgtttcgggacccgacgggggtacccgtcggtacgggtacggtacgtaacgtacggtaacgtcggtacggtctacggacctaaccg

SEQ ID NO: 354418 - DNA, 526 bp, Homo sapiens
  misc_feature: GZ8MTXP02GGYKH.44.7.A07.1.454.CMB.2.raw
  modified_base (264)..(264): a, c, t, g, unknown or other
  misc_feature (264)..(264): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (323)..(323): a, c, t, g, unknown or other
  misc_feature (323)..(323): n is a, c, g, or t
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcaccctggacagtcgcctcatctcctgcacgtctgatcggagcctcttacatactaatgggaatacttatttgtattggtacctanagaggccaggccagtcnccgnagctcctagtccagcaaaggttccagtccgtcttttcnggacgtgtcagacaggatcgngtcgctccggctcgaagaaacngattcacactgacaatcagccgcgtggaggctggcgagtgcgttgggttgtttatacgtgtcttgctaagtctttagaccggttactacgtttcggccgtacggggacccggtcgtacggtacggtacgaagtcgtaacgtggtcggtctcggactaccg

SEQ ID NO: 354419 - DNA, 634 bp, Homo sapiens
  misc_feature: GZ8MTXP02I1MVC.44.7.A07.1.454.CMB.2.raw
  modified_base (339)..(339): a, c, t, g, unknown or other
  misc_feature (339)..(339): n is a, c, g, or t
  modified_base (366)..(366): a, c, t, g, unknown or other
  misc_feature (366)..(366): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcaccctggacagtcgcctccatctcctgcacgtctgagtcggacgtccttcttacatactaagtagggaagtacttattgtagttcggtacctacagacggccaggccaggcgccgcacgcctacctagtccagacaacggttccacgtccgtcttttcgnggtacgtgtacgagaacgaggatacgnggtcgcgtccggactacgaaacgaaactagtaactttacaactactacgaacaagtacgaacgccggacgggtacgggacggtcgtaggaccgggtagttcggtcggttaggggtttacgttttacgtttacgtcgtcgttacgtacgtaacgttacgttaaccgggtaccgttacggttacgtttacggggacccggtaccgggggacccggtacggtacggtacggtaacgtaacgtcgtaacgtcggacgtcgtcgacctacccg

SEQ ID NO: 354420 - DNA, 591 bp, Homo sapiens
  misc_feature: GZ8MTXP02HQAJG.44.7.A07.1.454.CMB.2.raw
  modified_base (325)..(325): a, c, t, g, unknown or other
  misc_feature (325)..(325): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtccaccctggacagtcggcctccatctcctgcacgtctgatcggagcctcttacatactaagtggaagtacttattgtattggtacctacagaggccaggccagtcgccgcagctcctagtccagctaacggttccagccgtctttcnggagtgtcagtacaggactcgaggttggactccggcctacaaacggaaaacagtaactttcaacactacgaaacaaatacgacggaccgcggtgggacggtcgtggcggtatggtcgttgggttgttttaattacgtgtcgttgacgtaagtcgtttaacggaccggttacgttacgttttcgggaccggtacgggggtacccggtcgtcggggtaacggtacgtaaacgtacgtaacgttcggtcggtcgtacggtacctaaccg

SEQ ID NO: 354421 - DNA, 577 bp, Homo sapiens
  misc_feature: GZ8MTXP02G2VF2.44.7.A07.1.454.CMB.2.raw
  modified_base (209)..(209): a, c, t, g, unknown or other
  misc_feature (209)..(209): n is a, c, g, or t
  modified_base (298)..(298): a, c, t, g, unknown or other
  misc_feature (298)..(298): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (378)..(378): a, c, t, g, unknown or other
  misc_feature (378)..(378): n is a, c, g, or t
  modified_base (428)..(428): a, c, t, g, unknown or other
  misc_feature (428)..(428): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtccaccctggacagtcgcctccatcctcccgnacgtctgatcggagccttcttaacattaactaagtgggaaagtctttattgtattcggtacctacgagacggccaggccagtccgccgnagctctagccagcaaggtccagccgtntttcgnggatcgtcagacaggtactcgagtcgcctccggctacgaagaaaacngtacttacaactactagaacaatcgacgccgacgtgggagcgtggcgtanggtcgttggttagtttattactgtcttgacgtaagtcgttaacggtaccgttaacgtacgtttcggaccggtacgggggacccgtcggtacgggtacgtacgaaacgtaacgtaaacgttcggtacggcgttacggaccctaccgtacg

SEQ ID NO: 354422 - DNA, 566 bp, Homo sapiens
  misc_feature: GZ8MTXP02G7TC9.44.7.A07.1.454.CMB.2.raw
  modified_base (281)..(281): a, c, t, g, unknown or other
  misc_feature (281)..(281): n is a, c, g, or t
  modified_base (312)..(312): a, c, t, g, unknown or other
  misc_feature (312)..(312): n is a, c, g, or t
  modified_base (319)..(319): a, c, t, g, unknown or other
  misc_feature (319)..(319): n is a, c, g, or t
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
  modified_base (369)..(369): a, c, t, g, unknown or other
  misc_feature (369)..(369): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtccaccctggacagtcgcctcatctcctgcacgtctgatcggatcctctacatactaatgggaatacttattgtattggtacctacagagccagccagtcgcgnacgctctagtccagcaaggttccagtccgtnttttcgnggagtcgtcagacaggatcgnggtcgctacccgggntacgaagtaaaacngtacttcaactactagaacaaatcacgccgcgtagggacgctaggcggtagtcggtcgttgggttagtttacgttacgtgtcttacgactaaggttacgttaacggtccgttaacgttacggtttcggccggtaacggggacccggtcgtacgggtacgtacgtaacgtacgaacggtgtacggcgtcggactaccg

SEQ ID NO: 354423 - DNA, 638 bp, Homo sapiens
  misc_feature: GZ8MTXP02GSBIE.44.7.A07.1.454.CMB.2.raw
  modified_base (190)..(190): a, c, t, g, unknown or other
  misc_feature (190)..(190): n is a, c, g, or t
  modified_base (225)..(225): a, c, t, g, unknown or other
  misc_feature (225)..(225): n is a, c, g, or t
  modified_base (388)..(388): a, c, t, g, unknown or other
  misc_feature (388)..(388): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtccaccctggacngtcgcctcatctcctgcacgtctgatcggatcctnttaacatactaagtgggaatactttatttgtattggtacctacagacggccaggccagtcgccgcagtctcctagtccagtcaacggttccagtccgttcttttcgtgggacgtgtcaagtacgaggtacttcgaggtcgccgtccggctacgaagaaaaccngtaactttaccaactactagtaacaatacgaacggccgtcggtacgggacggtcgtgggccggtaagtggtcgttgggtttagttttaacgttaccgtgtcgtttacggacgtaacggttacgtttaaacgggtacccggtttaaccgttaccggttttacgggccccgggtaacgggggtaccccgggtacgtacgggggtagttaaccgaagttacgaaacggttcggtacggtcgtcggactaaccg

SEQ ID NO: 354424 - DNA, 690 bp, Homo sapiens
  misc_feature: GZ8MTXP02FT0TX.44.7.A07.1.454.CMB.2.raw
  modified_base (270)..(270): a, c, t, g, unknown or other
  misc_feature (270)..(270): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtccacccctggacagtccgcctccatcctcctgcacgtctgatcggatcctcttacattactaagtgggaatacttattgtattggtacctanagacgccaggccagtcgccgcagtcctcctaggtccagaccgtaaacggtccagtcccgttcttttcgtgggtacgtcgtacaaggtaccaggaacttcgagggtcggcccgtcccgggtactacgaaacgtaaaacgacgttaatttaccaacgtactaacggaaactaaactcgaaccggcccgcgggttggggacggtcggtacggtcgggtagtcggttcgtttagggtttacgtttttaagttaccgttgtccgtttaggtaacgtaacggtttaccgtttaaacgggtaacccggttaacgttaccggtttttacggggacccgggtaaacgggggtaccccggtcgggtttaaggggacggtttaccgaaacggtacgtaaacggttcggtcggtacgtccggacgtaacccg

SEQ ID NO: 354425 - DNA, 682 bp, Homo sapiens
  misc_feature: GZ8MTXP02INYAK.44.7.A07.1.454.CMB.2.raw
  modified_base (221)..(221): a, c, t, g, unknown or other
  misc_feature (221)..(221): n is a, c, g, or t
  modified_base (283)..(283): a, c, t, g, unknown or other
  misc_feature (283)..(283): n is a, c, g, or t
  modified_base (322)..(322): a, c, t, g, unknown or other
  misc_feature (322)..(322): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcaccctggacagtcgcctccatctcctgcacgtctgatcggancctattacatactaagtggaatacttattgtattggacctagagagccaggccagtcgccgnacgctcctagtccagctaacggttccagccgtctttcgnggacgtcgtacagtacgaggtactacgagggttcgggccctacccggggtacttaacgaaacgtaaaaacctaggtaactttaccgaaacctaacgttacggaaacgtaaacttaccgaaaccggcccggtacggttacgggggaacggtaccgttacggggcccgggtaaagttcgggttaccgtttgggtttacggttttaacgtttaacgtcggttacgtttacggtacgtaacggttcgtttaaacggtaacccggtttacgttacggttttacgggaccggtaccgggggtaacccggtcggtacgggtacggtacgaacgtacgtaacgtcggtacgccgtacggacctaaccg

SEQ ID NO: 354426 - DNA, 547 bp, Homo sapiens
  misc_feature: GZ8MTXP02GME5L.44.7.A07.1.454.CMB.2.raw
  modified_base (223)..(223): a, c, t, g, unknown or other
  misc_feature (223)..(223): n is a, c, g, or t
  modified_base (266)..(266): a, c, t, g, unknown or other
  misc_feature (266)..(266): n is a, c, g, or t
  modified_base (325)..(325): a, c, t, g, unknown or other
  misc_feature (325)..(325): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcacccctggacagtcggcctccatctcctgcacgtctgatcggancctcttacatactaatgggaatacttattgtattggtacctanagaggccaggccagtcgccgcagctcctagtccagctaaggttccagtccgtctttcgnggacgtgtcagtacaggatcgagtcggctcggctcgaagaaacagtactttcaacacgtacgaacaatcacgtccgcggtaggagctggcggatgtcgtggttagtttattacgtgtcttgactagtcgttagaccggttactacgttttcggccgtaacggggcccgtcgtacgggacggtacgtaacgtcgaaacgttggtacggtctcggacctaaccg

SEQ ID NO: 354427 - DNA, 606 bp, Homo sapiens
  misc_feature: GZ8MTXP02JHT54.44.7.A07.1.454.CMB.2.raw
  modified_base (223)..(223): a, c, t, g, unknown or other
  misc_feature (223)..(223): n is a, c, g, or t
  modified_base (269)..(269): a, c, t, g, unknown or other
  misc_feature (269)..(269): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcacccctggacagtcggcctcatctcctgcacgtctgatcggacncctacttacatactaagtggaatactttattgtattggtacctaanagtacggaccaggccagtcgccgcagctcctagtccagactaaggttccagtccgtacttttcgaggacgtgtacgagacaggtactacgacggttgggaccctccgggtacctacgaaacggaaaactgtaaactttacaaacctactacgtaactaaaactccgaaccgtccggtacggtagggacggtccgtacgggacggtagtcggtacggttcggttacggtttaattcgtgtacgttgactagtacgtttacgacgttaactaggtttcggaccgtacgggacccggtgtacgggacgtacaagtacgtacgtcggtggactcgactacg

SEQ ID NO: 354428 - DNA, 730 bp, Homo sapiens
  misc_feature: GZ8MTXP02FRVGX.44.7.A07.1.454.CMB.2.raw
  modified_base (192)..(192): a, c, t, g, unknown or other
  misc_feature (192)..(192): n is a, c, g, or t
  modified_base (229)..(229): a, c, t, g, unknown or other
  misc_feature (229)..(229): n is a, c, g, or t
  modified_base (376)..(376): a, c, t, g, unknown or other
  misc_feature (376)..(376): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtccaccccgtggacnggtccggcctccatcctcctgcacgtctgatcggacncctctacatactaagtgggaatactttatttgtaattcggtaacctagagtacggccagggcccaggtccgccgcacggtcctaccgtaacggtcccaaggcccgtaaagggtttcccaacggttccccggttcttttttaccgggngggtacgttccgtacgaaggaccgaggtactacggtgggtccgccgtaccggactaacgaaacgtaaactcttacttaccaactacgtagaactaacgtccgacggtaccgtacggtacgggacggtcgtagggtacggtagtcgttcggtttagggtttacgttttacgtacgttcggttcgtttacggtaacgttaacggttaccgtttaaacgggtacccggttttaacgtttaccgggttttaccggggacccggggtaaccgggggtacccggttacgggttaccgggtaacggttaaccgaacggttacggtaacggttcgggtacggtcgtaccggtaccgtaaccg

SEQ ID NO: 354429 - DNA, 654 bp, Homo sapiens
  misc_feature: GZ8MTXP02HEZ38.44.7.A07.1.454.CMB.2.raw
  modified_base (221)..(221): a, c, t, g, unknown or other
  misc_feature (221)..(221): n is a, c, g, or t
  modified_base (347)..(347): a, c, t, g, unknown or other
  misc_feature (347)..(347): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcaccctggacagtcgcctcatctcctgcacgtctgactcggancctattaacatactaagtgggaatacttattgtattcggtaacctagaggaggccaggccaggtccgccgcacgtcctacctacgtccgaagccgtaaaggttcccaggtcccgttctttttacgnggacgttcgactaagaacgagggactcgagtcgggacctccgggactaccgaaagaaactacgtaacttacaactactacgaactaaactacgacggaccgtacgggtagggacgggtaccgtgggaccgggagtcgtggttacggtttagtttaagttaccgttgtcgttgacgtaacggttacgtttaacgtaaccggttaccttacggttttaccgggaccggtaacgggggtacccggtcggtacgggtacggtaaccgtaacgtcggtaaacgttcggtaggtccgttacggaccttaaccg

SEQ ID NO: 354430 - DNA, 668 bp, Homo sapiens
  misc_feature: GZ8MTXP02F7UJK.44.7.A07.1.454.CMB.2.raw
  modified_base (352)..(352): a, c, t, g, unknown or other
  misc_feature (352)..(352): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatcctggattgagtgcggatattgtggtgacccagactccactctctctgtctgtccacccctggacagtcggcctcatctcctgcacgtctgactcggactcctacttaacattactaagtagggtaatactttatttgtattcggtaacctagagacggccaggccaggtccgccgcacgccttacctagtccagaccgtaaacggttccacggtccgttcttttcgnggtacgttcgtacaggaacgacgtacgtcgacggttcggccgttaccgggacttacgaaaacgtaaacgtacgttaactttacaacctaacgtacgaaactaacgtaccgcggtaccgacgggtacggacggcgttcggacggtcgttggtaccgttagggtttacgttttaacttaccgttggttacgttacgggaactaacgggtttaccgttaaacgggtacccgtttacgttaccggtttacggaccgggtacggggtacccgtggtaacggtcgtaacgaacgtcgtaacgttcggctcgtacgctaaccg

SEQ ID NO: 354431 - DNA, 652 bp, Homo sapiens
  misc_feature: GZ8MTXP02GQP2W.44.7.A07.1.454.CMB.2.raw
  modified_base (348)..(348): a, c, t, g, unknown or other
  misc_feature (348)..(348): n is a, c, g, or t
  modified_base (383)..(383): a, c, t, g, unknown or other
  misc_feature (383)..(383): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtccacccctggacagtcgcctccatcctcctgctacgtctgatcggactcctcttacatactaagtgggaatacttattgtattcggtacctagagacgccaggccaggtccgccgacacgtccttaccctagtccaagtccgtaaacggttcccacgtccgttctttcgnggtacggttcgtacaacggtacagggtacttacgngggttcgccgttaccgggctaaccgaagtaaaccagttacttacaacgtactacgaactaacgtacgaaccggtccgtacggtcgggacgtcgtagggccggtaattcggtacgtttgggtttacggttttaacttaccgtcggttcgttacgtaacgtaaggttacgttaaccggtaccgtttaaccgttccgggtttacggaccggtaccggggaccgtacggttacggacgtacgaagttacgaacgttggacgtcgtcgactacg

SEQ ID NO: 354432 - DNA, 600 bp, Homo sapiens
  misc_feature: GZ8MTXP02F2RTD.44.7.A07.1.454.CMB.2.raw
  modified_base (189)..(189): a, c, t, g, unknown or other
  misc_feature (189)..(189): n is a, c, g, or t
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
  modified_base (372)..(372): a, c, t, g, unknown or other
  misc_feature (372)..(372): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatccctggattgagtgcggatattgtggtgacccagactccactctctctgtctgtcaccctgaacngtcgcctcatctcctgcacgtctgatcggacncctcttanataactaagtaggaatacttatttgtaagttcggtaacctacgagacggacccaggccaggtccgccgacacgtctccgtagtccagcctaaacggttccacgtccgtattttcgaggtacgtcgtacaggactaggacttgnggtcgtccgtccgactacgaaacgaaactagtactttacaactacgtagaaactaatcgaacggccgtcgggtaggacgtcgtacggcgtagtggtcgttaggtttacgtttaatccgtgtcgttgtacgtagttacgtttaaggaccgttacgttaacggtttcgggacggacggggtcccgagtacgggagtacgaacgtacgtaagtcggagtccgagctaaccg

SEQ ID NO: 354433 - DNA, 543 bp, Homo sapiens
  misc_feature: GZ8MTXP02JXAG6.44.7.A07.1.454.CMB.2.raw
  modified_base (223)..(223): a, c, t, g, unknown or other
  misc_feature (223)..(223): n is a, c, g, or t
  modified_base (264)..(264): a, c, t, g, unknown or other
  misc_feature (264)..(264): n is a, c, g, or t
  modified_base (280)..(280): a, c, t, g, unknown or other
  misc_feature (280)..(280): n is a, c, g, or t
  modified_base (338)..(338): a, c, t, g, unknown or other
  misc_feature (338)..(338): n is a, c, g, or t
  modified_base (369)..(369): a, c, t, g, unknown or other
  misc_feature (369)..(369): n is a, c, g, or t
  modified_base (439)..(439): a, c, t, g, unknown or other
  misc_feature (439)..(439): n is a, c, g, or t
  modified_base (499)..(499): a, c, t, g, unknown or other
  misc_feature (499)..(499): n is a, c, g, or t
  modified_base (506)..(506): a, c, t, g, unknown or other
  misc_feature (506)..(506): n is a, c, g, or t
  modified_base (534)..(534): a, c, t, g, unknown or other
  misc_feature (534)..(534): n is a, c, g, or t
tcagacagtatatacacgaccggtgctcgatttagcacgtgtcgcagggggaccaggacttctcagttcatcttctcaccatgaggctccctgctcagctcctggggctgctaatgctctggatcctggattgagtgcggatattgtggtgacccagactccactctctctgtctgtccaccctggacacgtcggcctcatctcctgcacgtctgactcggancctctacatactaagtggaatcttattgtatggtaacctanagacgcagcagtcgcncagctctagtccagtcaacggttcagtccgtctttcgaggacttgacagacaggtacncgtaggtcggctccggctacgaagtaaaccngtacgttcactacgtacgaacaactcgagacggtcgtggacgctaggcgtagtgtacgtggttgtttaancgttgacttgactagtcttaacgcggttaattaccgtttcggaccggtacggggacccgngtacggnggtctaagttcgaacttcggacggtacncgtacaccg

SEQ ID NO: 354434 - DNA, 517 bp, Homo sapiens
  misc_feature: GZ8MTXP01BGVR2.21.35.D02.1.454.CMB.2.raw
  modified_base (247)..(247): a, c, t, g, unknown or other
  misc_feature (247)..(247): n is a, c, g, or t
  modified_base (383)..(383): a, c, t, g, unknown or other
  misc_feature (383)..(383): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtgaaggccattcacatctccaagagcaattccaaagacacgctgtttctgacaaatgancagacctagaaagagagacacggctagtatataactgtgcgcgaggaccttagttattagtggttcagggaactagttgacttacgtggggcagggacccttggtccaccgtctcctcacgtcccttcgaaccg

SEQ ID NO: 354435 - DNA, 512 bp, Homo sapiens
  misc_feature: GZ8MTXP01CE5RN.21.35.D02.1.454.CMB.2.raw
  modified_base (255)..(255): a, c, t, g, unknown or other
  misc_feature (255)..(255): n is a, c, g, or t
  modified_base (293)..(293): a, c, t, g, unknown or other
  misc_feature (293)..(293): n is a, c, g, or t
  modified_base (331)..(331): a, c, t, g, unknown or other
  misc_feature (331)..(331): n is a, c, g, or t
  modified_base (347)..(347): a, c, t, g, unknown or other
  misc_feature (347)..(347): n is a, c, g, or t
  modified_base (453)..(453): a, c, t, g, unknown or other
  misc_feature (453)..(453): n is a, c, g, or t
tcagtcgtcgctcgcacgaccggtgctcgatttagcacacgatagttgggtttgggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggagcgtgttccagcctgggacgtccctgagagtctcctgtgcagcctntggattcagcttcagtgacttgccatgcactgggtccncagactccaggcaaggggctagagtggctggcagttancgcattccgatggaancgataatgtcatgcggactccggtgaaagggccgattcaccatctccagagacaattccaagaacacgctgtttctgacaaatgagcagcctagaagaagaggacncggctgttatattaacgtgtgcgcgaggtaaccttattaattatggttcaagggctaag

SEQ ID NO: 354436 - DNA, 541 bp, Homo sapiens
  misc_feature: GZ8MTXP01ECVBO.21.35.D02.1.454.CMB.2.raw
  modified_base (247)..(247): a, c, t, g, unknown or other
  misc_feature (247)..(247): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgaatatgtactatgcggactccgtgaagggccattcacatctcaagagcaaattccaaagacacgctgtttctagacaaatgagcagacctagaaagaagaggacacggctagtaatataactgtagcgcgagtaccttaagttattagtggttacagggtaacctagttgacgttacgtgggggaccacggggaacccttgggtaacctaccgtctcctcacgtcccttccgaacccg

SEQ ID NO: 354437 - DNA, 519 bp, Homo sapiens
  misc_feature: GZ8MTXP01EKFR6.21.35.D02.1.454.CMB.2.raw
  modified_base (378)..(378): a, c, t, g, unknown or other
  misc_feature (378)..(378): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaaggccgattcacatctcccaagagaacaattccaaagacacgctgtttacngcaaatgagcagcctagaaagaagagacacggctgtatataactgtgcgcgaggtaccttattattatggttcagggaacctattgacttacgtggggccagggacccttggtccacgtctcctcacgtccttcgaacccg

SEQ ID NO: 354438 - DNA, 506 bp, Homo sapiens
  misc_feature: GZ8MTXP01AUERN.21.35.D02.1.454.CMB.2.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
  modified_base (340)..(340): a, c, t, g, unknown or other
  misc_feature (340)..(340): n is a, c, g, or t
  modified_base (346)..(346): a, c, t, g, unknown or other
  misc_feature (346)..(346): n is a, c, g, or t
  modified_base (405)..(405): a, c, t, g, unknown or other
  misc_feature (405)..(405): n is a, c, g, or t
  modified_base (423)..(423): a, c, t, g, unknown or other
  misc_feature (423)..(423): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttancgcattcgatggaancgatatgtactatgcgactcgtgaaggccattcacatcncaaganaacaatccaaagacacgctgtttctgacaaatgagcagactagaaagagaggacacggntagtatataactgtgcgngagacttatattatgttcaggaactattgacttacgtgggccagggacccttggtccaccgtctcctcacgtccttcgaaccg

SEQ ID NO: 354439 - DNA, 523 bp, Homo sapiens
  misc_feature: GZ8MTXP01A8N8I.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactcgtgaaggccattcacatctccaagagaacaattccaaagaacacgctgtttctgacaaatgagcagcctagaaagaagagacacggctgtatataaactgtgcgcgaggtaccttattattatggttcagggtaacctattgacttacgtggggccacgggacccttggtccaccggtctcctcacgtccttccgaacccg

SEQ ID NO: 354440 - DNA, 536 bp, Homo sapiens
  misc_feature: GZ8MTXP01AXKN2.21.35.D02.1.454.CMB.2.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (348)..(348): a, c, t, g, unknown or other
  misc_feature (348)..(348): n is a, c, g, or t
  modified_base (375)..(375): a, c, t, g, unknown or other
  misc_feature (375)..(375): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttancgcatttcgatggaagcgatatgtactatgcgactcgtgaaggccattcacatctccaaganaacaattccaaagaacacgctgtttcngacaaatgagcagactagaaagagagacacggctagtatataactgtgcgcgagtaccttattattagtggttcagggtaacctagttgacttacgtcgggccgaacggggttacccttgggtaaccacccggttcctccgtcacgtcccttccgaacccg

SEQ ID NO: 354441 - DNA, 519 bp, Homo sapiens
  misc_feature: GZ8MTXP01EQ9JP.21.35.D02.1.454.CMB.2.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (374)..(374): a, c, t, g, unknown or other
  misc_feature (374)..(374): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccnccagactccaggcaaggggctagagtggctggcagttancgcattcgatggaagcgatatgtactatgcgactcgtgaaggccattcacatctccaagagaacaattccaaagacacgctgtttcngacaaatgagcagacctagaaagaagaggacacggactagtaatataacgtgtagcgcgagtacttattatatgttcaggaactagttgacttacgtggggccacgggaccttggtccaccgtctcctcacgtccttccgaaccg

SEQ ID NO: 354442 - DNA, 523 bp, Homo sapiens
  misc_feature: GZ8MTXP01D2O71.21.35.D02.1.454.CMB.2.raw
  modified_base (247)..(247): a, c, t, g, unknown or other
  misc_feature (247)..(247): n is a, c, g, or t
  modified_base (349)..(349): a, c, t, g, unknown or other
  misc_feature (349)..(349): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtgaaggccattcacatctccaagancaattccaaagaacacgctgtttctgcaaatgagcagacctagaaagaagaggacacggctgtataataactgtgcgcgagtacttaattattatggttcagggaacctattgacttacgtggggccaagggacccttggtccaccggtctcctcgacgtcccttccgaacccg

SEQ ID NO: 354443 - DNA, 585 bp, Homo sapiens
  misc_feature: GZ8MTXP01ARVY3.21.35.D02.1.454.CMB.2.raw
  modified_base (248)..(248): a, c, t, g, unknown or other
  misc_feature (248)..(248): n is a, c, g, or t
  modified_base (290)..(290): a, c, t, g, unknown or other
  misc_feature (290)..(290): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccgaggcgaaggggctaggagtggctggcagttancgcattcgatggaagcgatatgtactagtggcggactccggtaggaacgggccgtattccactatcctaccaaagacgaactaaacttaccaaagaaccacgtcttgtttcagacaaatgagcagactagaaagagagacacggctagatataactgtagcgcgagtacctttaattattagtggttacagggtaacctagttcgacgttacggtcggggaccgttacggggttacccgttcgggtaaccctacccggtccttcccgtacgaccgtccccttaacccgaacccgg

SEQ ID NO: 354444 - DNA, 517 bp, Homo sapiens
  misc_feature: GZ8MTXP01ANTT4.21.35.D02.1.454.CMB.2.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (339)..(339): a, c, t, g, unknown or other
  misc_feature (339)..(339): n is a, c, g, or t
  modified_base (367)..(367): a, c, t, g, unknown or other
  misc_feature (367)..(367): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttancgcattcgatggaagcgatatgtactatgcgactcgtgaaggcattcacatcncaagagcaatccaaagacacgctgttcngacaaatgagcagcctagaaagagaggacacggctagtatataactgtagcgcgagtacctttagttattagtggttcagggtaacctagttgacttacgtggggccacgggacccttgggtcaccgtctcctcacgtccttccgaaccg

SEQ ID NO: 354445 - DNA, 535 bp, Homo sapiens
  misc_feature: GZ8MTXP01A7CTQ.21.35.D02.1.454.CMB.2.raw
  modified_base (248)..(248): a, c, t, g, unknown or other
  misc_feature (248)..(248): n is a, c, g, or t
  modified_base (381)..(381): a, c, t, g, unknown or other
  misc_feature (381)..(381): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccaggcaaggggctagagtggctggcagttatcgcattcgatggaagcgatatgtactatgcggactcgtgaaggccattcacatctccaagagaacaaattcccaaagaacacgtcttagtttcngtacaaatgagcagacctagaaagaagaggacacggctagtatataactgtagcgcgaagtacctttattattatggttcaagggaacctagttcgacttacgtggggaccagggacccttggtccacgtcctcctcacgtccttccgaacccg

SEQ ID NO: 354446 - DNA, 548 bp, Homo sapiens
  misc_feature: GZ8MTXP01C23JQ.21.35.D02.1.454.CMB.2.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (343)..(343): a, c, t, g, unknown or other
  misc_feature (343)..(343): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccnccagactccaggcaaggggctagagtggctggcagttancgcattcgatggaagcgatatgtactatgcggactccgtgaggccgattcacatcnccaagagaacaattccaaagacacgctgttctgacaatgagcagactagaaagaagagacacggctagtatactaacgtgtagcgcgaggtacctttaattattagtggttcgaagggtaacctagttcggtacttacggtggggaccttacggggacccttgggtaaccacccggtctccgtacgacgtccttcccgaacccgg

SEQ ID NO: 354447 - DNA, 561 bp, Homo sapiens
  misc_feature: GZ8MTXP01A1ZFT.21.35.D02.1.454.CMB.2.raw
  modified_base (246)..(246): a, c, t, g, unknown or other
  misc_feature (246)..(246): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactcaggcaagggctagagtggctggcagttatcgcattcgatggagcgatatgtactatgcggactcgtgaaggcgattcacatctccaagacgaacaacttaccaaagtaacacgtcttagtttctagactaaatgagcaagacctagaaaagaagacggaacacgggactagtaatataacgtgtagcgcgaagtacctttaattattaagtggttacaggggaacctagtttcggacttacgtgggggaccaggggaaccccttgggtcccacccggttctccctaccgacgtcccttccgaacccg

SEQ ID NO: 354448 - DNA, 563 bp, Homo sapiens
  misc_feature: GZ8MTXP01BH331.21.35.D02.1.454.CMB.2.raw
  modified_base (248)..(248): a, c, t, g, unknown or other
  misc_feature (248)..(248): n is a, c, g, or t
  modified_base (349)..(349): a, c, t, g, unknown or other
  misc_feature (349)..(349): n is a, c, g, or t
  modified_base (385)..(385): a, c, t, g, unknown or other
  misc_feature (385)..(385): n is a, c, g, or t
tcagtcgtcgctcgcacgaccggtgctcgatttagcacacgatagttgggtttgggggaagaggaagactgacggtcctgccacaggtggtgctgggcacagtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccgaggcgaaggggctaggagtggctggcagttatcgcattcgatggaagcgatatgtactatgcggactcgtgaaggcccatcacatcacagngacaattccaaagacacgcttgttcagacaaatgancagctagaaagagagacacgctaggtatataactgtagcgcgaggtacctttattaagttagtcggtttacgaagggtaccttagtttacgaaccgttacggtcgggggacccgacggggaaaccccgttgggtaccctaaccgttccctcccgttaccaaccggttccctaaccccg

SEQ ID NO: 354449 - DNA, 540 bp, Homo sapiens
  misc_feature: GZ8MTXP01BEJ5U.21.35.D02.1.454.CMB.2.raw
  modified_base (247)..(247): a, c, t, g, unknown or other
  misc_feature (247)..(247): n is a, c, g, or t
  modified_base (302)..(302): a, c, t, g, unknown or other
  misc_feature (302)..(302): n is a, c, g, or t
  modified_base (528)..(528): a, c, t, g, unknown or other
  misc_feature (528)..(528): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcatttcgatggaancgatatgtactatgcggactccgtgaaggcgattcacatctccaagagaacaattccaaagacacgcttgttctgcaaatgagcagacctagaaagaagaggacacggctagtataataactgtagcgcgaggtacctttaattattagtggttacaggggaacctaatttggacttacgtgggggccacggggacccttgggtaaccaccaacgtctcccttacnccgcctaacccg

SEQ ID NO: 354450 - DNA, 552 bp, Homo sapiens
  misc_feature: GZ8MTXP01B6T1O.21.35.D02.1.454.CMB.2.raw
  modified_base (398)..(398): a, c, t, g, unknown or other
  misc_feature (398)..(398): n is a, c, g, or t
  modified_base (533)..(533): a, c, t, g, unknown or other
  misc_feature (533)..(533): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccggtgaacgggccattccacatcctccaagacgaacaaattcccaaagaacacgtaccttgtttctgacaaatgancagacctagaaagaagaggacacggactagtaatataacgtgtgcgcgaggtacctttagttattagtggttcaggggaacctagttgaacttcgtacggggccacgggttaacccttgggtccaccggtctccncacgtcccttccgaacccg

SEQ ID NO: 354451 - DNA, 535 bp, Homo sapiens
  misc_feature: GZ8MTXP01BRR5F.21.35.D02.1.454.CMB.2.raw
  modified_base (247)..(247): a, c, t, g, unknown or other
  misc_feature (247)..(247): n is a, c, g, or t
  modified_base (336)..(336): a, c, t, g, unknown or other
  misc_feature (336)..(336): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccncagactccaggcaaggggctagagtggctggcagttatcgcattcgatggaagcgatatgtactatgcggactcgtgaggccattcacntctcaagagaacaattacccaaagaacacgtcttgtttctgacaaatgagcagacctagaaagagagacaggctagtataataacgtgtagcgacgagtacctttattagttatggttacagggaacctagttgacttacgtggggccaggggacccttgggtaacccaccgtcctcctacgactccgttcccgaaccg

SEQ ID NO: 354452 - DNA, 558 bp, Homo sapiens
  misc_feature: GZ8MTXP01A5DE4.21.35.D02.1.454.CMB.2.raw
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactcaggcaaggggctagagtggctggcagttancgcagttcgatggaagcgatatgtactatgcgactcgtgaggcgactcacatctcaagancaatccaaanacacgctgttcagacaaatgagcagactagaaagaagagacacggctagtataataacgtgtgacgcgaggtaccttaagttacttaagtggttacgagggtaacctagttacgacgttacgtcggggaccacggggttaaccccttgggtaacccgtacccggtccttacccgtccgacggtccccttaaccgtaaccccgg

SEQ ID NO: 354453 - DNA, 555 bp, Homo sapiens
  misc_feature: GZ8MTXP01BAYX5.21.35.D02.1.454.CMB.2.raw
  modified_base (248)..(248): a, c, t, g, unknown or other
  misc_feature (248)..(248): n is a, c, g, or t
  modified_base (374)..(374): a, c, t, g, unknown or other
  misc_feature (374)..(374): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtgaaggccattcacatctcaagagaacaatccaaagacacgctgtttcngacaaatgagcagacctagaaagagaggacacggctagtatataacgtgtagcgcgtaggtacctttaattattagtggttacgaaggggtaacctagttacgacttacggtcgggggacccaacggggttaacccttcgggtccaccggtcctcccgtcgaccgtcccttcccgaacccg

SEQ ID NO: 354454 - DNA, 631 bp, Homo sapiens
  misc_feature: GZ8MTXP01D0APO.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactagtgcggactccgtgaacgggccgattccacatcctaccaagacgaacaaattaccaaagtaaaccacgcttggttttctagacaaaatggaagcaacggtacctaaggaaaagaacggaaggacaacggtactaggtaataactaaacgtggtacgcgtcggaggtacctttaattagttaacgttggttacgagggtaacctattacggtacgttaacggtacgggggtacccgaaccgggggttaaacccgttcggggtaaccctacccggttccctcccgttaccgacccgccccgttaaccccgaaaccccgg

SEQ ID NO: 354455 - DNA, 583 bp, Homo sapiens
  misc_feature: GZ8MTXP01EHD6I.21.35.D02.1.454.CMB.2.raw
  modified_base (247)..(247): a, c, t, g, unknown or other
  misc_feature (247)..(247): n is a, c, g, or t
  modified_base (289)..(289): a, c, t, g, unknown or other
  misc_feature (289)..(289): n is a, c, g, or t
  modified_base (342)..(342): a, c, t, g, unknown or other
  misc_feature (342)..(342): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactccaggcaaggggctagagtggctggcagttatcgnattcgatggaagcgatatgtactatgcggacacgtgaaggccattccacatcnccaagagaacataccaaagacacgcttgttctgacaaatgagcagacctagaaagagaggacacggctagtagtaataacgtgtagcgacgaaggtacctttaattagttagttaggttacgaaggggtaacctagtttacgtaaccgttacggtacgggggacccgaacgggggttaaccccttcgggtaacccgacccgttcctacccgtaccacggtccccttaacccgaaaccccgg

SEQ ID NO: 354456 - DNA, 569 bp, Homo sapiens
  misc_feature: GZ8MTXP01DKR59.21.35.D02.1.454.CMB.2.raw
  modified_base (248)..(248): a, c, t, g, unknown or other
  misc_feature (248)..(248): n is a, c, g, or t
  modified_base (290)..(290): a, c, t, g, unknown or other
  misc_feature (290)..(290): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
  modified_base (363)..(363): a, c, t, g, unknown or other
  misc_feature (363)..(363): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccaggcaaggggctagagtggctggcagttatcgnattcgatggaagcgatatgtactatgcggactccgtgaggccattccacatcncaagancaatccaaagaacncgcttgttctgacaaatgagcagactagaaagaagaggacacggactagtaataataactgtgcgacgaaggtacctttaatttaattagttcggttacgaagggtaacctagttggtaacttacggttacgggggccaacggggttaacccttcgggttaaccacccggttcttcccgtacaccgtccccttaacccgaacccgg

SEQ ID NO: 354457 - DNA, 553 bp, Homo sapiens
  misc_feature: GZ8MTXP01DP4AX.21.35.D02.1.454.CMB.2.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttancgcatttcgatggaagcgatatgtactatgcgatcgtgaggccattcacatctccaagagaacaattccaaagacacgcttgtttcagacaaatgagcaagacctagaaagaagaggacacggactagtaatataacgtgtagcgcgaggtaccttaattattagtggttacagggtaacctagttgaacgttacgtacgggggaccgttacggggttaacccttcgggtccaccgttctcccgtcacgtcccttaacccgaacccg

SEQ ID NO: 354458 - DNA, 529 bp, Homo sapiens
  misc_feature: GZ8MTXP01DM7TI.21.35.D02.1.454.CMB.2.raw
  modified_base (289)..(289): a, c, t, g, unknown or other
  misc_feature (289)..(289): n is a, c, g, or t
  modified_base (350)..(350): a, c, t, g, unknown or other
  misc_feature (350)..(350): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgnattcgatggaagcgatatgtactatgcggactccgtagacggccattcacatctccaaganaacaattacccaaagtaaccacgcttgttctgacaaatgagcagcctagaaagaagagacacggctagtatataacgtgtgcgacgaggtaccttattattagtggttcgagggaacctagttgacttacgtgggcacgggttaccttggtcaccgtctcctcacgcccttccgaaccg

SEQ ID NO: 354459 - DNA, 568 bp, Homo sapiens
  misc_feature: GZ8MTXP01EJ0ZZ.21.35.D02.1.454.CMB.2.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (394)..(394): a, c, t, g, unknown or other
  misc_feature (394)..(394): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactccaggcaaggggctagagtggctggcagttancgcattcgatggaagcgatatgtactatgcggactccgtagaacggaccgattccacatcctaccaaagacgaactaaacttacccaaagaaccacgtcttgtttacngacaaatgagacagacctagaaagaagagacacggatagtaatataacgtgtacgcgcgaaggtaccttaattattagtggttacgagggaacctagttagacgttacgtcggggaccacggggacccttcggtccaccggtcctaccctcgacgtcccttaacccgaacccgg

SEQ ID NO: 354460 - DNA, 543 bp, Homo sapiens
  misc_feature: GZ8MTXP01BXH99.21.35.D02.1.454.CMB.2.raw
  modified_base (419)..(419): a, c, t, g, unknown or other
  misc_feature (419)..(419): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagactccgaggcgaaggggctagagtggctggctagtatcgcattcgatggaagcgatatgtactatgcgactcgtgaggcatcacatctcaagagaacataccaagacacgcttgttcagacaaatgagcagacctagaaagagagacacggactgtatataacgtgngcgcgagtaccttaattattagtgtacgagggaacctagttacgacgttaggtcggggaccacggggttacccttcgggtaaccacccgttcctacccgtcgaccgtcccgttccgaaccccgg

SEQ ID NO: 354461 - DNA, 563 bp, Homo sapiens
  misc_feature: GZ8MTXP01CJQZ0.21.35.D02.1.454.CMB.2.raw
  modified_base (250)..(250): a, c, t, g, unknown or other
  misc_feature (250)..(250): n is a, c, g, or t
  modified_base (293)..(293): a, c, t, g, unknown or other
  misc_feature (293)..(293): n is a, c, g, or t
  modified_base (411)..(411): a, c, t, g, unknown or other
  misc_feature (411)..(411): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcacgtgggtccnccagacctccgaggcgaaggggctaggagtggctggcagttancgcattcgatggaagcgatatgtactagtgcggtactcgaggacgggcctacttccaccatcctaccgaaagacgaacaaattacccaaagaaccacgtcttgttctagacaaatgancagactagaaagagacggacacggctagtatataacgtgtagcgcgagtactttatattagtggtacgaggtaactagttgacttcggtcgggccgacgggacccttggtccctaccgttcctccctcgacgtccccgttaaccgaacccgg

SEQ ID NO: 354462 - DNA, 560 bp, Homo sapiens
  misc_feature: GZ8MTXP01D9K7W.21.35.D02.1.454.CMB.2.raw
  modified_base (249)..(249): a, c, t, g, unknown or other
  misc_feature (249)..(249): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (382)..(382): a, c, t, g, unknown or other
  misc_feature (382)..(382): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccnccagactccgaggcgaaggggctaggagtggctggctagttatcgcattcgatggaagcgatatgtactatgcgactcgtagaacggccatcacatcnccaaganaacaataccaaagaacacgcttgtttcngacaaatgagcagactagaaagaagagacacggactagtataataacgtgtagcgacgaggtacctttaattattagtggttacagggtaacctagttgaacttacggtcggggaccacgggttacccttggtaacccaccggttcctccctcgaccgtccccgttaaccgaacccgg

SEQ ID NO: 354463 - DNA, 541 bp, Homo sapiens
  misc_feature: GZ8MTXP01EHL1J.21.35.D02.1.454.CMB.2.raw
  modified_base (426)..(426): a, c, t, g, unknown or other
  misc_feature (426)..(426): n is a, c, g, or t
  modified_base (519)..(519): a, c, t, g, unknown or other
  misc_feature (519)..(519): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccgccagactccgaggcaaggggctagagtggctggcagttatcgcattcgatggaagcgatatgtactagtgcggactccgtgaacgggccgtacttccaccatcctaccaaagacgaacaattcccaaagacacgtcttgtttctgacaaatgagacagactagaaagagagacacggntagtatataactgtgcgacgagttacttaattattagtgttacagggtaactattgacttacgtggggaccagggacccttggtccaccgtcncctcacgtccttaaccgaaccg

SEQ ID NO: 354464 - DNA, 551 bp, Homo sapiens
  misc_feature: GZ8MTXP01AX58S.21.35.D02.1.454.CMB.2.raw
  modified_base (246)..(246): a, c, t, g, unknown or other
  misc_feature (246)..(246): n is a, c, g, or t
  modified_base (272)..(272): a, c, t, g, unknown or other
  misc_feature (272)..(272): n is a, c, g, or t
  modified_base (436)..(436): a, c, t, g, unknown or other
  misc_feature (436)..(436): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactccgaggtacggcgtagagnggctggcagttatcgcattcgatggaagcgatatgtactatgcggactcgtggaaggcgacttccaccatctccagaacgacaattaccaaagaacacgctgttctgacaaatgagcagccctaagaaagaagaggacacggactataactataacgtgtgcgngaaggtacctttatttagtctgggttcaagggacctaattcgacgttacgttggggacccaagggttaccccttgggttccaacccgtctcctcgacgccctccaacggaaccgg

SEQ ID NO: 354465 - DNA, 548 bp, Homo sapiens
  misc_feature: GZ8MTXP01DZYPL.21.35.D02.1.454.CMB.2.raw
  modified_base (248)..(248): a, c, t, g, unknown or other
  misc_feature (248)..(248): n is a, c, g, or t
  modified_base (361)..(361): a, c, t, g, unknown or other
  misc_feature (361)..(361): n is a, c, g, or t
  modified_base (422)..(422): a, c, t, g, unknown or other
  misc_feature (422)..(422): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagactccgaggcaaggggctaggagtggctggacagttatcgcattcgatggaagcgatatgtactatggcggactccgtaggaacgggccattccacatcctaccaaganaacaattaccaaagaacacgcttgtttcagacaaatgagcagactagaaagagagacaggntagtataataacgtgtgcgagagtactttaattattagtcggttacgagggtaactagttcgacttacgtcgggaccacggggttacccttgggtccaccgttctcctcacgtcccttccgaaccg

SEQ ID NO: 354466 - DNA, 677 bp, Homo sapiens
  misc_feature: GZ8MTXP01ET3WH.21.35.D02.1.454.CMB.2.raw
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (327)..(327): a, c, t, g, unknown or other
  misc_feature (327)..(327): n is a, c, g, or t
  modified_base (342)..(342): a, c, t, g, unknown or other
  misc_feature (342)..(342): n is a, c, g, or t
tcagtcgtcgctcgcacgaccggtgctcgatttagcacacgatagttgggtttgggggagaggagcccagcactggaagtcgccggtgtttccattcggtgatcagcactgaacacagaggactcaccatggagtttgggctgaccttgggttttcctcgttgcttcttttaagaggtgtccactgtcaggtccacgtggtggaggtcgggggaggcgtgtccagccgtgggactcctgagngtctctgtgcagcctntggattcagtcttcagtgtacttgccatgcacgtcgggtcccgccagacctccgagcgaaggggctagngtgctggcagttacncgctagttccgagtaggaagcgtattaagtacgttaactacgtcgggaccggtaccgtaccggtaaggggaaacgggacccgtacttaccaacctactacctaaccgaagtaaacgtaaacctaaactaaccgaaaacgaaccgtaacgtacctttacgtttacgtacgtaaacgtaaagtacggaagaccgaacgaacgtaaaggaaaaggtaaacggaacggaacgaacgggtaacttaagttaaataaacgttaaacgtcggtacggacggttacggttaacggttaactttagtttaagttaggttcggttaacgtaacggttaacgtaag

SEQ ID NO: 354467 - DNA, 554 bp, Homo sapiens
  misc_feature: GZ8MTXP01C6TGP.21.35.D02.1.454.CMB.2.raw
  modified_base (247)..(247): a, c, t, g, unknown or other
  misc_feature (247)..(247): n is a, c, g, or t
  modified_base (342)..(342): a, c, t, g, unknown or other
  misc_feature (342)..(342): n is a, c, g, or t
  modified_base (379)..(379): a, c, t, g, unknown or other
  misc_feature (379)..(379): n is a, c, g, or t
  modified_base (531)..(531): a, c, t, g, unknown or other
  misc_feature (531)..(531): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccgaggcaaggggctagagtggctggcagttatcgcattcgatggaagcgatatgtactatgcggtactccgtgaaggccattccacntctaccaagagaacaatccaaagaacacgctagttcngacaaatgagcagactagaaagaagagacacggctagtataataactgtgacgcgagtacttaattattagtggttacgaagggtaacctagttcgaacgttacggtagggggccaaacggggttacccttacgggtccaccgtccttcccncacgtccccttaaccgaacccgg

SEQ ID NO: 354468 - DNA, 523 bp, Homo sapiens
  misc_feature: GZ8MTXP01AEWAC.21.35.D02.1.454.CMB.2.raw
  modified_base (247)..(247): a, c, t, g, unknown or other
  misc_feature (247)..(247): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtagaggccattcacatctccaagacgaacaatccaaagacacgtctgtttcagtacaaatgagcagacctagaaagagagacacggctagtatataactgtgcgcgaggtacttaattattagtggttacagggtaaccagttgacttacgtgggccgagggacccttggccacgtcctctcacgtccttccgaacccg

SEQ ID NO: 354469 - DNA, 528 bp, Homo sapiens
  misc_feature: GZ8MTXP01BDH32.21.35.D02.1.454.CMB.2.raw
  modified_base (248)..(248): a, c, t, g, unknown or other
  misc_feature (248)..(248): n is a, c, g, or t
  modified_base (504)..(504): a, c, t, g, unknown or other
  misc_feature (504)..(504): n is a, c, g, or t
  modified_base (511)..(511): a, c, t, g, unknown or other
  misc_feature (511)..(511): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcgtatcgcatgatggagcgatatgtactatgcggactccgtgaggcgactcaccatctccagaagacaatacaaacgaacacgctgttctagacaaatagagacagaccgtagaaaggaaagaggacgacgacgtagtatagtaacgtgtgcgacgaggtacttattattatggttagtacggacgaatgactaacgttgggacgacggaaccgttgcgtaacnctcctcncgcctccaaccgaaccg

SEQ ID NO: 354470 - DNA, 657 bp, Homo sapiens
  misc_feature: GZ8MTXP01CFUL6.21.35.D02.1.454.CMB.2.raw
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggagcgtgttccagcctgggacgtcctgagagtctcctgtgcagcctctggattcagtcttcagtgacttgccatgcacgtgggtcccncagacctccgaggcgaagggggctaggagtggctggcagttancgcagttccgagtggaagcgataatgtaactagtcggacgggtactccggtagggaaacggggtcccgtattccaacctactcctaccgaagaacgaactaaacttacccaaagaaccaacgtcttaggtttacctaggtaacctaaagtgaacgaccgaacgtacccgtaaaggaaaaggtaaacggaacggaaccgaacgggtaacttaaggttaacttaagttaaaccgtggtacggaccgttacggttaacggttaaccctttaagtttaagtttaacgtcgggtttacgtaacggggttaacctttaagg

SEQ ID NO: 354471 - DNA, 573 bp, Homo sapiens
  misc_feature: GZ8MTXP01BAD6J.21.35.D02.1.454.CMB.2.raw
  modified_base (247)..(247): a, c, t, g, unknown or other
  misc_feature (247)..(247): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagactccaggcaaggggctaggagtggctggcagttatcgctattcgatggaagcgatatgtactatgcggatccgtagaagggccattcacatcctccaaagacgaacaaattcccaaagaaccacgtcttagtttcctagactaaatgacgacaacgtaccgtagaaaacggaaggaacggaacaccgggattagtaataataaacgtgtaggcgacgacggtactttattattagtggttcagggtaacctagttgacttacggtcggggcacgggttaccttggtccaccgttctccgtcacgtcccgttccgaacccgg

SEQ ID NO: 354472 - DNA, 518 bp, Homo sapiens
  misc_feature: GZ8MTXP01AV37D.21.35.D02.1.454.CMB.2.raw
  modified_base (247)..(247): a, c, t, g, unknown or other
  misc_feature (247)..(247): n is a, c, g, or t
  modified_base (319)..(319): a, c, t, g, unknown or other
  misc_feature (319)..(319): n is a, c, g, or t
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (495)..(495): a, c, t, g, unknown or other
  misc_feature (495)..(495): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccncagactcaggcaagggctagagtggctggcagtatcgcattcgatggaagcgatatgtactatgcgactcgngaggcatcacatcncaanancatccaanacncnctgttcngcaaatgancagactagaaagagagacacggctagtatataactggtgcgtacgaggtaccttaattacttagttcggttacaaggggtaacctagttgaccttagtcggggccagggcccttgggtcaccgttcnccctacgcgtcccttccgaaccg

SEQ ID NO: 354473 - DNA, 555 bp, Homo sapiens
  misc_feature: GZ8MTXP01DL276.21.35.D02.1.454.CMB.2.raw
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
  modified_base (358)..(358): a, c, t, g, unknown or other
  misc_feature (358)..(358): n is a, c, g, or t
  modified_base (396)..(396): a, c, t, g, unknown or other
  misc_feature (396)..(396): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagactccaggcaaggggctagagtggctggcagttancgnattcgatggaagcgatatgtactatgcggtactccgtagaagggcctattccactatcctccaaganaacaattccaaagaacacgcttgtttcagacaaatgancagctagaaagaagagacacgactagtaatataacgtgtacgcgacgaggtacttaattattagtggttacagggtaacctagttcgacttacggtcggggaccaacggggttacccttgggtcccaccggttcctcctcgacgtcccttccgaacccg

SEQ ID NO: 354474 - DNA, 599 bp, Homo sapiens
  misc_feature: GZ8MTXP01E2AJP.21.35.D02.1.454.CMB.2.raw
  modified_base (246)..(246): a, c, t, g, unknown or other
  misc_feature (246)..(246): n is a, c, g, or t
  modified_base (338)..(338): a, c, t, g, unknown or other
  misc_feature (338)..(338): n is a, c, g, or t
  modified_base (370)..(370): a, c, t, g, unknown or other
  misc_feature (370)..(370): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccncagactcaggcaagggctagagtggctggcagtatcgcattcgatggaagcgatatgtactatgcggactccgtgaagggccattcacatcnccaagagcaatccaaagaacacgcttgtttcngacaaatgagcagacctagaaagagagacacggctagtatataactggtacgacgcgaggtacctttatttagttagttcggttacgaagggggtaaccctaagtttacggaaacgttaccgggttacgggggaccccgttaacgggggttaaaccccgttcggggtaaccctaacccgggttccctaccccgttccgaaccgggtccccttaaccccgaaaccccggg

SEQ ID NO: 354475 - DNA, 564 bp, Homo sapiens
  misc_feature: GZ8MTXP01D2UXM.21.35.D02.1.454.CMB.2.raw
  modified_base (250)..(250): a, c, t, g, unknown or other
  misc_feature (250)..(250): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtcgggtccnccagactccgaggcgaaggggctaggagtggctggctagttancgnattcgatggaagcgatatgtactatggcgactcgagacggcctatcacntcacaagacaacaatccaaagaccngcttagttcagacaaatgancagactaagaaagaagagaacgacggactagtaataagtaacgtgtagacgacgagttaacttaatttagtagtggttcgaagggtaacctagttgacgttacggtcggggaccgaacgggttacccttgggtcccaccgttcctccgtcaccgtcccgttaacccgaacccgg

SEQ ID NO: 354476 - DNA, 578 bp, Homo sapiens
  misc_feature: GZ8MTXP01D72ME.21.35.D02.1.454.CMB.2.raw
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
  modified_base (325)..(325): a, c, t, g, unknown or other
  misc_feature (325)..(325): n is a, c, g, or t
  modified_base (340)..(340): a, c, t, g, unknown or other
  misc_feature (340)..(340): n is a, c, g, or t
  modified_base (344)..(344): a, c, t, g, unknown or other
  misc_feature (344)..(344): n is a, c, g, or t
  modified_base (346)..(346): a, c, t, g, unknown or other
  misc_feature (346)..(346): n is a, c, g, or t
  modified_base (362)..(362): a, c, t, g, unknown or other
  misc_feature (362)..(362): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccncagactccgaggcaaggggctagagtggctggctagttatcgcattcgatggaancgatatgtactatgcgactcgngaaggcatcacatcncaananaacaatccaaagaacncgtctgttctagacaaatgagcagacctagaaagaagagacacggactagtaatataacgtgtacgacgacgtacgtaacctttaagttagttagttggttacgaagggtaacctaagtttacgaaacgttacggtacggggaccgaacgggttaacccttcgggtaaccacccggttcttacccgtcgaaccggtccccttaacccgaaccccgg

SEQ ID NO: 354477 - DNA, 525 bp, Homo sapiens
  misc_feature: GZ8MTXP01CUP8P.21.35.D02.1.454.CMB.2.raw
  modified_base (249)..(249): a, c, t, g, unknown or other
  misc_feature (249)..(249): n is a, c, g, or t
  modified_base (339)..(339): a, c, t, g, unknown or other
  misc_feature (339)..(339): n is a, c, g, or t
  modified_base (342)..(342): a, c, t, g, unknown or other
  misc_feature (342)..(342): n is a, c, g, or t
  modified_base (348)..(348): a, c, t, g, unknown or other
  misc_feature (348)..(348): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccncagactccaggcaaggggctagagtggctggcagttatcgcattcgatggaagcgatatgtactatgcggactccgtgaggccattcacntcncaagancaatccaaagacacgcttgtttctgacaaatgagcagacctagaaagaagaggacacggactgtaattataactgtgcgcgaggtacttattagttatggttcagggtaactagttgacttcgtcggggccacgggcccttggtccaccgttctcctcgacgtcccttccgaacccg

SEQ ID NO: 354478 - DNA, 593 bp, Homo sapiens
  misc_feature: GZ8MTXP01AWMV0.21.35.D02.1.454.CMB.2.raw
  modified_base (247)..(247): a, c, t, g, unknown or other
  misc_feature (247)..(247): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccncagactccgaggcaaggggctaggagtggctggctagttatcgctattcgatggaagcgatatgtactagtggcggacttcggtaggaacggggtccacttccactatcctaccgaaagaacgtaactaaacttacccaaagaaccacgtcttagtttactagacaaagtcgagcaacgaccgtaaggaaaagaaggaacggacacggtactagtataactaacgtgtagcgacgtagtactttattattagtggttacagggtaacctagttcgacgttcggtcgggaccacggggttacccttgggtaaccaccggtcctcctcgaccgtcccttccgaacccg

SEQ ID NO: 354479 - DNA, 579 bp, Homo sapiens
  misc_feature: GZ8MTXP01EGLPB.21.35.D02.1.454.CMB.2.raw
  modified_base (252)..(252): a, c, t, g, unknown or other
  misc_feature (252)..(252): n is a, c, g, or t
  modified_base (295)..(295): a, c, t, g, unknown or other
  misc_feature (295)..(295): n is a, c, g, or t
  modified_base (409)..(409): a, c, t, g, unknown or other
  misc_feature (409)..(409): n is a, c, g, or t
  modified_base (555)..(555): a, c, t, g, unknown or other
  misc_feature (555)..(555): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcggggggagcgtgttccagcctgggacgtccctgagagtctcctgtgcagcctctggattcagcttcagtgtactttgccatgcacgtgggtcccncagacctccgaggcgaaggggctaggagtggctggctagttancgctattcgagtggaagcgatatgtaactagtggccggactccgtaggaacggcctattccacatccacaaagacaacaataccaaagaacacgtcttgtttcagacaaatgancagacagaaagaagagacacggactagtaataataacgtgtacgcgacgtaacgtaactttattagttagtaggttacgagggtaactagttacgacgttacggtcggggacccaacgggttacccttcgggtcctaccgtctccncgaccgtcccgttaaccgaacccg

SEQ ID NO: 354480 - DNA, 569 bp, Homo sapiens
  misc_feature: GZ8MTXP01CTG45.21.35.D02.1.454.CMB.2.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (302)..(302): a, c, t, g, unknown or other
  misc_feature (302)..(302): n is a, c, g, or t
  modified_base (341)..(341): a, c, t, g, unknown or other
  misc_feature (341)..(341): n is a, c, g, or t
  modified_base (350)..(350): a, c, t, g, unknown or other
  misc_feature (350)..(350): n is a, c, g, or t
  modified_base (368)..(368): a, c, t, g, unknown or other
  misc_feature (368)..(368): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcactgggtccnccagctccaggcaaggggctagagtggctggctagttancgcattcgatggaancgatatgtactagtgcggactccgtgacggcgattcacntctcaaganaacataccaaagtacacncttgttctgacaaatgagcagactagaaacgaagagacgacggctagtaataataaacgtgtagacgtcgaacggttaccttaagttattagtaggttacgaagggtaacctaagttgtaacttcggtacggggccgaacggggacccttggggttaacccaccggttcctcctacgaccggtcccttaaccgaaccccgg

SEQ ID NO: 354481 - DNA, 747 bp, Homo sapiens
  misc_feature: GZ8MTXP01B2YE0.21.35.D02.1.454.CMB.2.raw
  modified_base (258)..(258): a, c, t, g, unknown or other
  misc_feature (258)..(258): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctcgtggtattcagtcttcagttcgtactttcgcctatgctacgtcgggtccnccagactcgaggacgaagggctaggagtggctggctagttatcgactagttcgagtaggaagcgtaattagtagtaactgtcggaccgggtactaccggtaggaacgggtccttactacccactactcccgacaaagaacgaactaaacttaacccgaaagtaaccgtacgtcgtttacgtttacccaggtaacaaagtacggacgaacgtaaccggtaaccgtaaaggaaacggaaggaaccggtacgtacgttaacgttaagttaaacgttaacgttaacggttccggtacggtaacccggtaaggttaaccgtttaaccttttaaagttacgtttaacggttacggtaacggtaaccgggtaacttaaggttccggtaaaccggttcggggtaaccggggtaccggttaacccgggttaccgttcccggttaaccgtaccccttccgtcccgtaccgacccgttaaccccgaaccgtaaccccggg

SEQ ID NO: 354482 - DNA, 647 bp, Homo sapiens
  misc_feature: GZ8MTXP01AX9AS.21.35.D02.1.454.CMB.2.raw
  modified_base (252)..(252): a, c, t, g, unknown or other
  misc_feature (252)..(252): n is a, c, g, or t
  modified_base (295)..(295): a, c, t, g, unknown or other
  misc_feature (295)..(295): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcggggggaggcgtgttccagcctgggacgtccctgagagtctcctgtgcagcctctggattcagcttcagtgtactttgccatgcacgtgggtccnccagactccgaggcgaaggggctaggagtggctggctagttancgctagttcgagtggaagcgtattagtgtactagtcggcggacttccggtaggaacgggcctacttccactatcctacgaaagaacgaactaaactacccgaaagtaacctacgtcttagtttacagaactaaagtgaacgacaagtaccgtaagaaaagagaacggaacgacggtatagtaataataacgtgtacgacgtagtacgttactttaattagttagtaggttacgaacgggtaacctaagttacgtaaccgttacgggtacggggtaccgttaacggggttacccgttcggtcccacccggttcctacccgtaccgaccgtccccgttaacccgtaaccccggg

SEQ ID NO: 354483 - DNA, 643 bp, Homo sapiens
  misc_feature: GZ8MTXP01AMVM0.21.35.D02.1.454.CMB.2.raw
  modified_base (248)..(248): a, c, t, g, unknown or other
  misc_feature (248)..(248): n is a, c, g, or t
  modified_base (271)..(271): a, c, t, g, unknown or other
  misc_feature (271)..(271): n is a, c, g, or t
  modified_base (287)..(287): a, c, t, g, unknown or other
  misc_feature (287)..(287): n is a, c, g, or t
  modified_base (623)..(623): a, c, t, g, unknown or other
  misc_feature (623)..(623): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgactttgccatgcacgtgggtccncagactcgaggcgaagggctagngtggctagctagttancgactagttcgagtggaaagcgtaattagtagtactagtcggaccggactccggtaggaacggggcctaacttccacattcccacaaaggaacaactaaacttacccaaaagaacctacgtctttagtttaccagtaacaaaagtgaacgacgaacgaccgtaaagggaaaacgaaggaacgggaaccacgggtacttaagtaactaaagttaaacgtgggtacgaccggacgtaaggttaaccttttaagttaagttaggtcggttacgaacgggtaactagttacggacgttacgggtacgggacgaacgggttaccttcggtcaccgtctccncgaccgtccttcgaacccgg

SEQ ID NO: 354484 - DNA, 585 bp, Homo sapiens
  misc_feature: GZ8MTXP01DTS3D.21.35.D02.1.454.CMB.2.raw
  modified_base (250)..(250): a, c, t, g, unknown or other
  misc_feature (250)..(250): n is a, c, g, or t
  modified_base (291)..(291): a, c, t, g, unknown or other
  misc_feature (291)..(291): n is a, c, g, or t
  modified_base (306)..(306): a, c, t, g, unknown or other
  misc_feature (306)..(306): n is a, c, g, or t
  modified_base (350)..(350): a, c, t, g, unknown or other
  misc_feature (350)..(350): n is a, c, g, or t
  modified_base (405)..(405): a, c, t, g, unknown or other
  misc_feature (405)..(405): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtggggtccnccagactccgaggcaaggggctaggagtggctggcagttancgcattcgatggaancgaatatgtactatgcgactcgtagaggcatcacatcacaaganaacaataccaaagacacgcttgttcagacaaatgagcagactagaaagagagacncggatagtaatagtaacgtgtaggacgacgtaacgttaacctttaatttattagttacggttacgaacggggtaaccttagttacggaaccgttacgggtacgggggtacccgaacggggttacccttcgggtaaccctaccgttcctcccgtacaccggtccccttaaccgaaacccgg

SEQ ID NO: 354485 - DNA, 567 bp, Homo sapiens
  misc_feature: GZ8MTXP01D07LW.21.35.D02.1.454.CMB.2.raw
  modified_base (249)..(249): a, c, t, g, unknown or other
  misc_feature (249)..(249): n is a, c, g, or t
  modified_base (309)..(309): a, c, t, g, unknown or other
  misc_feature (309)..(309): n is a, c, g, or t
  modified_base (360)..(360): a, c, t, g, unknown or other
  misc_feature (360)..(360): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (443)..(443): a, c, t, g, unknown or other
  misc_feature (443)..(443): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtggggtccnccagacctccgaggcgaaaggggctaggagtggctggctagttatcgcattcgatggaancgaatatgtactatgcggactccgtagaacggccattccacatctcaaganaacaatccaaagacacgtcttgtttcnganaaatgagcagactagaaagaagaggacacggactagtaatataacgtgtgcgngtagtactttaattattagtggttcgaagggtaacctagtttcggaactttacggacggggtcccgaacggggttacccttgggtcctacccgtctccctcgaccgtccccttcccgaacccgg

SEQ ID NO: 354486 - DNA, 605 bp, Homo sapiens
  misc_feature: GZ8MTXP01AG0KP.21.35.D02.1.454.CMB.2.raw
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcacgtgggtccgcagactccgaggcgaaggggctagagtggctggcagttancgntattcgatggaagcgatatgtactatcgcggactcgtagaacggccattccacatctaccaaagacgaactaaactacccgaaagaaccacgtcttagtttctagactaaaatggaacgcaaggacctaagaaaacgaggaacggacacgggtcttaggtaagtaactaacgtgtacgacgacgaacgtacctttaagttattagtggttaccgagggtaacctagttcgacgttaacggtcggggaaccgttacggggaacccttcgggtaacctaccgtcctcctaccgacgtccccttccgtaaccccgg

SEQ ID NO: 354487 - DNA, 604 bp, Homo sapiens
  misc_feature: GZ8MTXP01DDJB5.21.35.D02.1.454.CMB.2.raw
  modified_base (249)..(249): a, c, t, g, unknown or other
  misc_feature (249)..(249): n is a, c, g, or t
  modified_base (276)..(276): a, c, t, g, unknown or other
  misc_feature (276)..(276): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (364)..(364): a, c, t, g, unknown or other
  misc_feature (364)..(364): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccgaggcgaaaggggctagngtggctggcagttancgnattcgatggaagcgatatgtactagtgcggactccggtaggaaacgggcctattccacatccacaaaganaacaaattaccgaaagaaccacgtcttagtttcagtacaaatgagacaagacgtaagaaaagaaggaacggaacaaccggattaggtaataagttaaacgtgtacgacggacgtaagtaacctttaattaattagtacgttacgaagggtaacctaagttacggtacttacggtacggggaccgttaacgggacccttgggttaacccacggtcctcgcttacgtccttaacccgaaccg

SEQ ID NO: 354488 - DNA, 729 bp, Homo sapiens
  misc_feature: GZ8MTXP01DTGIT.21.35.D02.1.454.CMB.2.raw
  modified_base (305)..(305): a, c, t, g, unknown or other
  misc_feature (305)..(305): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccaccgtggtggaggtcggggggagcgtgttccagcctgggacgtcctgagagtctcctgtgcagcctctggattcagtcttcagtgtacttgccatcgcacgtcgggtcccncagacctccgaggcgaaggggctagagtggctggctagttatcgctagttccgagtaggaagcgtaattaagtgtaactagtcgggaccggtaccgtccggtagggaaacgggtcccgtacttccaaccgtactccgtacccgaaaggtaaacgtaaacctaaacgttaccccgaaaacgtaaacccgtaccggtacgtttacggttttaccggtacggtaacctaaaaagtggaaacgtaccgaacgtaacccgtaaaagggaaaacggtaagggaaacgggaaccgtaacgggtaacttaaggttaaattaacgttaaaccggttagggtacggaccgggttacggttaaaccgggttaaccttttaagttttaacgtttaacggtacggggtttaccgaacgggggttaaccctttaaggg

SEQ ID NO: 354489 - DNA, 547 bp, Homo sapiens
  misc_feature: GZ8MTXP01BFK60.21.35.D02.1.454.CMB.2.raw
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
  modified_base (356)..(356): a, c, t, g, unknown or other
  misc_feature (356)..(356): n is a, c, g, or t
  modified_base (394)..(394): a, c, t, g, unknown or other
  misc_feature (394)..(394): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtcgggtccncagactccgaggcaaggggctaggagtggctggcagttancgcattcgatggaagcgatatgtactagtgcggactcggtgaacggccattccacatctaccaaganaacaattaccaaagacacgcttgtttctagacaatgancagctagaaagagagacacgatagtaagtataacgtgtagcgagacgtacctttattattagtcggttacgaggtaactagttggacttacggtcggggaccgacgggttacccttggtccctacgtctcctcaccgtccgttccgaacccgg

SEQ ID NO: 354490 - DNA, 550 bp, Homo sapiens
  misc_feature: GZ8MTXP01C96V3.21.35.D02.1.454.CMB.2.raw
  modified_base (246)..(246): a, c, t, g, unknown or other
  misc_feature (246)..(246): n is a, c, g, or t
  modified_base (405)..(405): a, c, t, g, unknown or other
  misc_feature (405)..(405): n is a, c, g, or t
  modified_base (432)..(432): a, c, t, g, unknown or other
  misc_feature (432)..(432): n is a, c, g, or t
  modified_base (531)..(531): a, c, t, g, unknown or other
  misc_feature (531)..(531): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactcgtagaaagggccattccacatctaccaaagacgaacaaacttccaaaaggaaccacggtcttggtttacctagacaaaatgaancaagcctaagaaagaaggagacacggntagtagtataaactgtgacgacgagtaccttattatatgttcaggtaaccattgaacttacgtcgggcaacggggaacccttgggtccacgtctccganacgcccttaaccaacccgg

SEQ ID NO: 354491 - DNA, 528 bp, Homo sapiens
  misc_feature: GZ8MTXP01D7W6H.21.35.D02.1.454.CMB.2.raw
  modified_base (249)..(249): a, c, t, g, unknown or other
  misc_feature (249)..(249): n is a, c, g, or t
  modified_base (352)..(352): a, c, t, g, unknown or other
  misc_feature (352)..(352): n is a, c, g, or t
  modified_base (365)..(365): a, c, t, g, unknown or other
  misc_feature (365)..(365): n is a, c, g, or t
  modified_base (390)..(390): a, c, t, g, unknown or other
  misc_feature (390)..(390): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtgaacggccattccacatctcaaganaacaattccaaanaacacgtctgtttctgacaaatgancagactagaaagagagacacggctagtataataacgtgtgcgagagtaccttattattagtgtcagggaacctattgacgttacgtcgggaccaagggccttcggcacccgtctccctcacgtcccttccgaacccgg

SEQ ID NO: 354492 - DNA, 539 bp, Homo sapiens
  misc_feature: GZ8MTXP01B4CQI.21.35.D02.1.454.CMB.2.raw
  modified_base (247)..(247): a, c, t, g, unknown or other
  misc_feature (247)..(247): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcgactcgtgaaggccattcacatctccaagagaacaaattccaaagaacacgcttgtttctagacaaatgagcagacctagaaagaagagacacggctagtatataactgtgcgcgagtacttagttattagtggtcagggtaacctagttgacgttacgtcggggccacggggaacccttggtcctacccggtcctcctacgaccgtcccttcccgaacccgg

SEQ ID NO: 354493 - DNA, 659 bp, Homo sapiens
  misc_feature: GZ8MTXP01B02AN.21.35.D02.1.454.CMB.2.raw
  modified_base (250)..(250): a, c, t, g, unknown or other
  misc_feature (250)..(250): n is a, c, g, or t
  modified_base (289)..(289): a, c, t, g, unknown or other
  misc_feature (289)..(289): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctctgtgcagcctctggattcagtcttcagtgtactttgccatgcacgtgggtccncagactcgaggcgaaggggctagagtggctggcagttancgctattcgagtggaagcgaatatgtactatggcgtactcgtaggaacgggcctattccactatcctaccgaaagaacgtaactaaactttaccgaaaagaacctacgtcttgtttactacgaactaaagtcgaacgacgaagaccgtaaggaaaagaacggaacggaacgtaacgggacttaaggtaattaaacgttaaacgtggtacggacggtacggtaacggttaacctttaagtttacgttagttacggttacgaagggtaacctagttacggtaacgttacgggtacggggaccgttaacggggttacccttcgggtaaccctacccgttctcccgtacgaccgtcccgttaacccgaacccgg

SEQ ID NO: 354494 - DNA, 526 bp, Homo sapiens
  misc_feature: GZ8MTXP01BFOY9.21.35.D02.1.454.CMB.2.raw
  modified_base (246)..(246): a, c, t, g, unknown or other
  misc_feature (246)..(246): n is a, c, g, or t
  modified_base (300)..(300): a, c, t, g, unknown or other
  misc_feature (300)..(300): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactccaggcaaggggctagagtggctggcagttatcgcattcgatggaancgatatgtactatgcgactccgtagaaggccattcacatctccaagagaacaatcccaaagacacgctgtttctgacaaatgagcagctagaaagagagacacgctagtatataactgtgcgcgagtacctttaatattatggttcagggaacctgttgacttacgtggggccttaacggggacccttgggtcctaccgtctccgtcacgtcccttaaccgaaccg

SEQ ID NO: 354495 - DNA, 593 bp, Homo sapiens
  misc_feature: GZ8MTXP01CNA0M.21.35.D02.1.454.CMB.2.raw
  modified_base (248)..(248): a, c, t, g, unknown or other
  misc_feature (248)..(248): n is a, c, g, or t
  modified_base (291)..(291): a, c, t, g, unknown or other
  misc_feature (291)..(291): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgacttgccatgcacgtgggtccnccagacctccgaggcaaggggctaggagtggctggctagttancgactattcgatggaagcgtaatatgtactagtgcggtactccgtagaacgggcctacttccactatcctaccgaaagacgaacctaacttaccaaagaccacgtacttgtttactgactaaatgagacaacgtacgtaagaaagaagaggacacggactagtagtaataacgtgtcgacgacgtaaggtacctttaagttattagtggttacgagggtaacctagttcgtacttaacggtggggaccacgggttaccttcggtaacctaccgtcctccgacacgtcccttaaccgaacccg

SEQ ID NO: 354496 - DNA, 533 bp, Homo sapiens
  misc_feature: GZ8MTXP01D0RDW.21.35.D02.1.454.CMB.2.raw
  modified_base (248)..(248): a, c, t, g, unknown or other
  misc_feature (248)..(248): n is a, c, g, or t
  modified_base (515)..(515): a, c, t, g, unknown or other
  misc_feature (515)..(515): n is a, c, g, or t
tcagtcgtcgctcgcacgaccggtgctcgatttagcacacgatagttgggtttgggggaagaggaagactgacggtcctgccacaggttgtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccaggcaaggggctagagtggctggcagttatcgcattcgatggaagcgatatgtactatgcgactcgtagaggccatcacatctcaagagaacaatccaaagacacgtcttgtttctagacaaatgagcagactagaaagaagagacacgactagtaatataactgtgcgacgtagtactttaattattagttggttacagggtaacctagttgacttacgtcgggggaccaaggggacccttgggtccaccgtctccncgacgtccttccgaaccg

SEQ ID NO: 354497 - DNA, 648 bp, Homo sapiens
  misc_feature: GZ8MTXP01EA9IN.21.35.D02.1.454.CMB.2.raw
  modified_base (250)..(250): a, c, t, g, unknown or other
  misc_feature (250)..(250): n is a, c, g, or t
  modified_base (256)..(256): a, c, t, g, unknown or other
  misc_feature (256)..(256): n is a, c, g, or t
  modified_base (291)..(291): a, c, t, g, unknown or other
  misc_feature (291)..(291): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcacgtgggtccncagacncgaggcgaaggggctaggagtggctggctagttancgctagttcgatggaagcgtaatagtgtaactagtggaccggacttccggtaggaacgggcctaacttccgaacatcctaccgaaagaacgaactaaacttacccgaaaacgaacctacgtctttagttttaccaggaactaaaagtggaacgacaacggtacctaaagggaaaacggaacggaacgggtaaccgaacgggtactaggttaaacttaagtaacgttcgtaggccggtacgtaacggttaactttaagttattagtcggttacgaaggtaactagttcgaacgttcggtacgggaccgaacggttccgttggtaacccacgttcctcgcacgtccccttcgaacccgg

SEQ ID NO: 354498 - DNA, 574 bp, Homo sapiens
  misc_feature: GZ8MTXP01DPGCF.21.35.D02.1.454.CMB.2.raw
  modified_base (262)..(262): a, c, t, g, unknown or other
  misc_feature (262)..(262): n is a, c, g, or t
  modified_base (301)..(301): a, c, t, g, unknown or other
  misc_feature (301)..(301): n is a, c, g, or t
  modified_base (416)..(416): a, c, t, g, unknown or other
  misc_feature (416)..(416): n is a, c, g, or t
  modified_base (435)..(435): a, c, t, g, unknown or other
  misc_feature (435)..(435): n is a, c, g, or t
tcagtcgtcgctcgcacgaccggtgctcgatttagcacacgatagtttgggtttgggggggagaggagcccagcactggaagtcgccggtgtttccattcggtgatcagcactgaaacacagaggactcaccatggagtttgggctgacctgggttttcctcgttgctcttttaagaggtgtccactgtcaggtccacctggtggagtcgggggagcgtgttccagccctgggacgtccctgagagtctcctgtgcagcctntggattcagcttcagtgacttgcatgcacgtcgggtccnccagactccgaggcaaggggctagagtggctggcagttatcgctattccgagtggaaagcgaataatgtaactagtgcggactcggtagaacgggcctattcacatctaccgaanacgactaactacaagaacncgtacttgttacgtagtaacaaagtgacgacacgacgtaaagaaagaagacgacgacgtctagttaataacgttacgtggtacgacgttcgttacggttaacttagttaagttagtcggttacgtaacggttaactaag

SEQ ID NO: 354499 - DNA, 592 bp, Homo sapiens
  misc_feature: GZ8MTXP01BE81N.21.35.D02.1.454.CMB.2.raw
  modified_base (249)..(249): a, c, t, g, unknown or other
  misc_feature (249)..(249): n is a, c, g, or t
  modified_base (290)..(290): a, c, t, g, unknown or other
  misc_feature (290)..(290): n is a, c, g, or t
  modified_base (350)..(350): a, c, t, g, unknown or other
  misc_feature (350)..(350): n is a, c, g, or t
  modified_base (440)..(440): a, c, t, g, unknown or other
  misc_feature (440)..(440): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccncagactcgaggcaaggggctaggagtggctggctagttacncgctattcgagtggaagcgatatgtactgtgcggactcggtagacgggcctattccactntccacgaaagacgaacaatacccaaagaactacgtctagtttcagacaaagtgacgacagaccgtaagaaacgaagacggaacgacggtntagtaactataacgtgagacgacgtagtacttattatagtggttacgagggtaacctagttcgaacgttacgggtacggggacccgttaacgggttacccgttcggtaacccacccgtccgtcctaccgacgtcccgttaacccgaacccgg

SEQ ID NO: 354500 - DNA, 634 bp, Homo sapiens
  misc_feature: GZ8MTXP01CIF9H.21.35.D02.1.454.CMB.2.raw
  modified_base (251)..(251): a, c, t, g, unknown or other
  misc_feature (251)..(251): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagtcttcagtgactttgccatgctacgtgggtccnccagactcgaggcaaggggctagagtggctggctagttancgntagttcgagtggaagcgaattatgtactagtgacggtactccggtagaacgggcctacttccactatcctaccaaagtaacaactaaattacccgaaagaaccacgtcttgtttactagaactaaaagtgaacgaccaaggtacctaaagggaaaaggaacgggaacggtaccgaacgggtacttagttaataacgttaacgtggacgacggacgtaacgttactttaatagttagtggttacaagggtaacctagttacgacgttacggtacgggaccgaacgggttacccttgggtaacccaccgttcctccgtaccgacgtccccttaaccgaaccg

SEQ ID NO: 354501 - DNA, 703 bp, Homo sapiens
  misc_feature: GZ8MTXP01BXDEZ.21.35.D02.1.454.CMB.2.raw
  modified_base (250)..(250): a, c, t, g, unknown or other
  misc_feature (250)..(250): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggactcctgagagtctcctgtgcagcctctggattcagtcttcagtgtactttgcctatgcacgtggggtccnccagacctccgaggccgaaggggctaggaggtggctggctagttatcgactagttcgagtaggaagcgtatatgtaactagtcggaccggtactccggtaggaaacgggtccgtacttaccactatcctaccgaaaagaacgtaactaaacttacccgaaaacgtaacctacgtcgtttagtttacctagaactaaaagtcgaacgaccaacggtaaccgtaaagggaaaaaggaaacgggaaacgggtaaccgaacgggtacttaaggttaaacttaacgttaaacggtggtacggacggtacggtaaacggttaacctttaagtttaagttacgttacgggttacgaacggggtaacctagttaggtaacgttacggtacgggggaccttaacgggttacccttcggtaacccaccgttcctccgtcaccgtccccgttaacccgaaccgg

SEQ ID NO: 354502 - DNA, 778 bp, Homo sapiens
  misc_feature: GZ8MTXP01BBLE0.21.35.D02.1.454.CMB.2.raw
  modified_base (250)..(250): a, c, t, g, unknown or other
  misc_feature (250)..(250): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcacgtgggtccnccagactccaggcaaggggctaggagtggctggcagttatcgcatttcgatggaagcgtatatgtactagtcgcggtactccggtaggaaacggggcctaattccacctatccctacccaaaggacgaacctaaacgttacccaaaaggaaacccacggtcctttagggtttttaccctaggtaacccaaaaaagttgggaaacgtaccgaacggtaccccgttaaagggaaaaacggaaaagggaaacggggaaaccttaacccggggggacttaacgggttaaacttaaagttaaaacccggtgggttacggggaacccggaccgggtaaaggggttaaaccccttttaaattttaaacgtttaggtttacggggttttaaccggaacgggggtaaccccttaaagttttacgggaaccgttaacgggttccgggggacccgttaacgggggaacccctttcgggggtaaccctaccccggttcctccccggtaccaccggtccccttaaccccgtaaaccccggg

SEQ ID NO: 354503 - DNA, 572 bp, Homo sapiens
  misc_feature: GZ8MTXP01DLD03.21.35.D02.1.454.CMB.2.raw
  modified_base (553)..(553): a, c, t, g, unknown or other
  misc_feature (553)..(553): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtccgccagactccaggcaaggggctagagtggctggctagttatcgcattcgatggaagcgatatgtactatgcggactccgtgaacgggcctattccacatcctccaagacaactaaatacccaaagaaccacgtcttgtttctagacaaatgagcaagacctaggaaaagaagacggacacgggtactagtaattaactaacgttggtcgcgacggtagtactttattattagtggtacaagggtaacctagttgtacgttacggtcggggccaacgggttaccttgggtccctaccggtctccncacgtcccttccgaacccg

SEQ ID NO: 354504 - DNA, 558 bp, Homo sapiens
  misc_feature: GZ8MTXP01AJDMU.21.35.D02.1.454.CMB.2.raw
  modified_base (247)..(247): a, c, t, g, unknown or other
  misc_feature (247)..(247): n is a, c, g, or t
  modified_base (342)..(342): a, c, t, g, unknown or other
  misc_feature (342)..(342): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgctattcgatggaagcgatatgtactatgcgactccgtgaaggccattcacatcncaagnaacatccaaagacacgctgttcngacaaatgagcagcctagaaagaagaggacacggctagtaagtataactgtcgacgcgaaggtacctttattattaagtggttaccagggtaacctaagttggaacttacgtacgggggaccacgggggttaacccttcgggtaacctaaccgtccgtaccctcgaaccgtccttaacccgaacccgg

SEQ ID NO: 354505 - DNA, 574 bp, Homo sapiens
  misc_feature: GZ8MTXP01A5BRX.21.35.D02.1.454.CMB.2.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (302)..(302): a, c, t, g, unknown or other
  misc_feature (302)..(302): n is a, c, g, or t
  modified_base (406)..(406): a, c, t, g, unknown or other
  misc_feature (406)..(406): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccncagactccgaggcaaggggctagagtggctggcagttancgcattcgatggaancgatatgtactatggcggactccggtagaaggggcctattccaccaatcctacccaaagacgaacaaacttccaaagaaccacgcttgtttactgacaaatgancagactagaaagagagacacggactagtagtaataacgtgtacgcgacgtacggtaacctttaattattagtggttacgaacgggaacctagttcgacgttacggtcggggaccaacgggttacccttgggtccaccggtcctcctcgacgtcccgttcccgaacccg

SEQ ID NO: 354506 - DNA, 574 bp, Homo sapiens
  misc_feature: GZ8MTXP01DBF0A.21.35.D02.1.454.CMB.2.raw
  modified_base (210)..(210): a, c, t, g, unknown or other
  misc_feature (210)..(210): n is a, c, g, or t
  modified_base (250)..(250): a, c, t, g, unknown or other
  misc_feature (250)..(250): n is a, c, g, or t
  modified_base (291)..(291): a, c, t, g, unknown or other
  misc_feature (291)..(291): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctntggattcagcttcagtgactttgccatgcacgtgggtccnccagactccgaggcgaaggggctagagtggctggcagttancgcattcgatggaagcgaatatgtactagtgcggtactccgtaggaacgggccgtacttccactatcctaccaaagacgaacaaacttacccgaaaagaaaccacgtcttagtttacctagacaaatgaagacagacctaggaaagaagaggacacggctagtaataattaacgtgtacgcgacgtagtacttaattattagtgtacgaggtaactagttgacttacggtgggaccgacgggacccttggtcaccgtctcctcacgtcccgttccgaacccgg

SEQ ID NO: 354507 - DNA, 614 bp, Homo sapiens
  misc_feature: GZ8MTXP01C4R4V.21.35.D02.1.454.CMB.2.raw
  modified_base (249)..(249): a, c, t, g, unknown or other
  misc_feature (249)..(249): n is a, c, g, or t
  modified_base (292)..(292): a, c, t, g, unknown or other
  misc_feature (292)..(292): n is a, c, g, or t
  modified_base (351)..(351): a, c, t, g, unknown or other
  misc_feature (351)..(351): n is a, c, g, or t
  modified_base (387)..(387): a, c, t, g, unknown or other
  misc_feature (387)..(387): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctctgtgcagcctctggattcagtcttcagtgtactttgccatgcacgtgggccncagactcgaggcgaaggggctagagtggctggcagttactcgntagttcgatggaagcgaatatgtactagtgcgtactcgtagaacggcctaacttcactntcctaccgaaagacaactaacttaccgaaagaaccncgtcttgttcctagacaaatgaacgcacgactaaggaaagaaggaggaacaggacttagtaataacgtaacgtgtacgacgacgtagttaactttattagttagtcgggtacaagggtaacctagttagaccgttacgggtcggggaccgttaacggggttaccccttggggtaaccctacccggttcctacccctacgttaccgtccccgttaacccgaacccggg

SEQ ID NO: 354508 - DNA, 563 bp, Homo sapiens
  misc_feature: GZ8MTXP01AD9KI.21.35.D02.1.454.CMB.2.raw
  modified_base (247)..(247): a, c, t, g, unknown or other
  misc_feature (247)..(247): n is a, c, g, or t
  modified_base (287)..(287): a, c, t, g, unknown or other
  misc_feature (287)..(287): n is a, c, g, or t
  modified_base (387)..(387): a, c, t, g, unknown or other
  misc_feature (387)..(387): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagactccgaggcaaggggctagagtggctggcagttancgcattcgatggaagcgatatgtactatggcggtactccgtagaacgggccgattccacatcctaccaagagaacaaatccaaagaccacgtctgtttcngacaaatgagcagctagaaagagagacaggctgtaatataactgtagcgcgagtacctttaattattagtggtacagggaacctagttcggaacttacggtcggggacccgttaacgggaccccttcgggtaaccctaccggtcctccctccgacgtccccttaacccgaacccgg

SEQ ID NO: 354509 - DNA, 579 bp, Homo sapiens
  misc_feature: GZ8MTXP01CGRBZ.21.35.D02.1.454.CMB.2.raw
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (347)..(347): a, c, t, g, unknown or other
  misc_feature (347)..(347): n is a, c, g, or t
  modified_base (556)..(556): a, c, t, g, unknown or other
  misc_feature (556)..(556): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccgccagactccgaggcgaaggggctaggagtggctggcagttancgnattcgatggaagcgatatgtactatgcgactcgtagacggctacttcacatcnccaagacgaacaattaccaaagacacgtacttgttactagactaaatgacgaccagaccgtaggaaagaagaggacacggtatagtaataataacgtgtacgcggtacgtaacggtacctttagttaattagttacgggttacgaggggtaaccctagttacgacgttacggtcggggccacgggttaccttcggtccaccgtcctccncgaccgtcccgttccgaacccgg

SEQ ID NO: 354510 - DNA, 765 bp, Homo sapiens
  misc_feature: GZ8MTXP01DWPS2.21.35.D02.1.454.CMB.2.raw
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagtgtactttgccatgcacgtgggtccgcagactccgaggcgaaggggctagagtggctggcagttancgnattcgatggaagcgtaatatgtactagtgcggtacttccggtaggaacgggtcctacttccgacctagttcctacccgaaaagaacgtaactaaacttacccgaaaagtaaacctaccgtctttacgtttactagtaactaaagttggaacgaccgtaacggaacccgttaagggaaaaggaaacgggaacggaaaccgaaccggggtacttaacggttaaagttaaacgttaaaccggttggtacgggaaccgggtaccggttaaacgggtttaaacccttttaaagttttaaacgtttaaggttacgggttaacccggtaacggggtaaacccttaggtttacggtaaccggtttaaccgggttacggggggaaccccgttaaccgggggttaacccgttacgggtaaccctaacccggttcccgttaccctaccgacccgtaaccccgttaaccccgaaaccccgggg

SEQ ID NO: 354511 - DNA, 622 bp, Homo sapiens
  misc_feature: GZ8MTXP01EFZ4H.21.35.D02.1.454.CMB.2.raw
  modified_base (249)..(249): a, c, t, g, unknown or other
  misc_feature (249)..(249): n is a, c, g, or t
  modified_base (383)..(383): a, c, t, g, unknown or other
  misc_feature (383)..(383): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccaggcaaggggctagagtggctggcagttatcgcattcgatggaagcgatatgtactgtgcggactccggtagaacgggtccacttcacatcctacccaaagagaactaaattacccaaagaaacncgtcttggtttactagacaaaatgaacgcagacctaggaaaagaagaggaacacgggcttagtataataactgtgacgacgtaaggtacctttaattagttaacgttggtacgtaaggggtaacctagttcgaaacgttcggtacgggggacccgttaacgggggaccccttacgggggttaacccaacccgggttcccttaccctacggttacccgtccccttaacccgaaccccggg

SEQ ID NO: 354512 - DNA, 759 bp, Homo sapiens
  misc_feature: GZ8MTXP01CN7KJ.21.35.D02.1.454.CMB.2.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcactgggtccnccagactccaggcaaggggctagagtggctggcagttancgctattcgagtggaagcgtaatatgtactagtggacggtactccggtgaaacggggccgtacttaccacgtatcctacccgaaagacgaacctaaatttacccgaaaagtaaaccaccggtctttacgggtttacctacgtaacctaaaagttggaacggtaccgaacggtacccgtaaagggaaaacggaaacgggaaacggggaaaccgaacggggtaccttaagggttaattaaacgttaaaccgtggttacggaccggtaacggtaaccgggttaaaccttttaagtttaacgtttaggttacgggtttaccggtaacggggtaaccctaaggtttacggtaaccgttacgggtacgggggtacccgaacgggggttaacccccgtttacggggttaaccccgtaacccggtttccctaccccgttaccggaacccggttcccccgttaacccggtaaacccccggg

SEQ ID NO: 354513 - DNA, 548 bp, Homo sapiens
  misc_feature: GZ8MTXP01AG2H5.21.35.D02.1.454.CMB.2.raw
  modified_base (246)..(246): a, c, t, g, unknown or other
  misc_feature (246)..(246): n is a, c, g, or t
  modified_base (285)..(285): a, c, t, g, unknown or other
  misc_feature (285)..(285): n is a, c, g, or t
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactccaggcaaggggctagagtggctggcagttancgcattcgatggaagcgatangtactatggcggactccggngaagggccattcacatcctccaagagaacaattcccaaagaacacgtctgtttctagcaaatgagcagacctagaaagaagagacaggctgtatataactgtagcgacgagtaccttaattagttatggttacagggtaacctaagttgaacttacgtggggaccaggggaaccccttggtaacctacccgtcctcccgtacacgtcccttaaccgaacccg

SEQ ID NO: 354514 - DNA, 603 bp, Homo sapiens
  misc_feature: GZ8MTXP01DJ9FH.21.35.D02.1.454.CMB.2.raw
  modified_base (249)..(249): a, c, t, g, unknown or other
  misc_feature (249)..(249): n is a, c, g, or t
  modified_base (291)..(291): a, c, t, g, unknown or other
  misc_feature (291)..(291): n is a, c, g, or t
  modified_base (389)..(389): a, c, t, g, unknown or other
  misc_feature (389)..(389): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccgaggcgaaggggctaggagtggctggcagttancgctattcgatggaagcgatatgtactagtgcggactccgtaggaagggcctattccaaccatcctaccaaagaacgaacaaattacccaaagaaccncgtcttagtttcagacaaatgagcagactaggaaagagagacacggtactagtaataagtaacgtgtagacgacgtaggtacctttaattagttagtaggtacgaagggtaacctagtttacgaacgttacggtcggggaccgaacggggttaccccttagggtccctaacccggttcctaccccgtcgaccgtccccgttaaccgaaccccgg

SEQ ID NO: 354515 - DNA, 580 bp, Homo sapiens
  misc_feature: GZ8MTXP01CX0F3.21.35.D02.1.454.CMB.2.raw
  modified_base (249)..(249): a, c, t, g, unknown or other
  misc_feature (249)..(249): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (351)..(351): a, c, t, g, unknown or other
  misc_feature (351)..(351): n is a, c, g, or t
  modified_base (365)..(365): a, c, t, g, unknown or other
  misc_feature (365)..(365): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccnccagactccgaggcgaaggggctagagtggctggcagttancgnatttcgatggaagcgatatgtactatggcgactccggtagaacgggcctattccaacntcctaccaaagaanaacaaattaccaaagaaccacgtcttgttacagacaaatgagacagactagaaagagagacaggctagtaatataacgtgtagcgtacgagtacctttaattacttagtcggttacgacgggtaactagttacgacgttacggtcggggaccaacggggttacccgttggtaacccaccggttctcccgtccacggtccccttaaccgaacccgg

SEQ ID NO: 354516 - DNA, 586 bp, Homo sapiens
  misc_feature: GZ8MTXP01B6K3Q.21.35.D02.1.454.CMB.2.raw
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
  modified_base (340)..(340): a, c, t, g, unknown or other
  misc_feature (340)..(340): n is a, c, g, or t
  modified_base (369)..(369): a, c, t, g, unknown or other
  misc_feature (369)..(369): n is a, c, g, or t
  modified_base (382)..(382): a, c, t, g, unknown or other
  misc_feature (382)..(382): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcactgggtccnccagactccaggcaaggggctagagtggctggcaggttancgnattcgatggaagcgatatgtactatggcgactccgtgaggccattcacntctccaagacgaacaattccaaagaaccncgtcttgtttccngacaaatgagcagacctagaaacgaagaggacacggctagtataataacgtgtacgacgcgtaacggtacctttaagttagttagtcggttacgaagggtaacctagttacgtaacgttacggtcgggggacccttaacggggttacccttcgggtaaccctacccggttctcccgtcgttaccggcccttaacccgaacccgg

SEQ ID NO: 354517 - DNA, 818 bp, Homo sapiens
  misc_feature: GZ8MTXP01AIB3S.21.35.D02.1.454.CMB.2.raw
  modified_base (249)..(249): a, c, t, g, unknown or other
  misc_feature (249)..(249): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtgggtccnccagactccgaggcaaggggctaggagtggctggctagttatcgctagttcgatggaagcgtatagtgtactagtgaccggtactccggtaggaacgggccgtacttccgactacgtcctacccgaaagtaacgaactaaacgttacccaaaggtaaacctaccgttctttacgttttaccctaggaaactaaaaagtggaaacgccgaaacggtaccccgttaaagggaaaaaacggtaaagggaaaccgggtaaacccgaaaccggggtacgtttaaacgggtttaaaacgttaaaccgtttaaaaccggggttggttaaccggggtacccggtaaaccggggtaaacggtttaaacccctttttaaagtttaaacgttttaagggtttaaccggggtttaacggaaacgggggtaaccccttaaaggtttaccgggaaccgtttacggggtaaccggggggtacccgaaacccgggggttaaccccttcgggggttaacccctaacccgggttccccttaccccgtaccggaacccggttccccttaaccccggtaaacccccggg

SEQ ID NO: 354518 - DNA, 725 bp, Homo sapiens
  misc_feature: GZ8MTXP01CSZI7.21.35.D02.1.454.CMB.2.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccnccagactcgaggcaaggggctagagtggctggcagttancgctagttcgatggaagcgtatatgtactagtcgcggtactccgtaggaacggccgtaacttccaaccattccctacccgaaagaaacgtaacctaaactttacccgaaaagtaacccaacgtccttacggtttacctacgtaacctaaaagttgaaacgtaccgtaaacggacccgttaaagggaaaaagaaacgggaacggaaaccgaacgggtacgttaaggttaattaaacgttaaacgttggtacgacggtacgtaacgggttaaccttttaagtttaattaggttacggttacgaacggggtaaccctaagttcggtaaaccgttacggttaccgggggaacccttaacggggttaaaccccgttcgggttaaccctaccccggttaaccttccccgtacgttaccgtcccccgttaaccgtaaaccccggg

SEQ ID NO: 354519 - DNA, 606 bp, Homo sapiens
  misc_feature: GZ8MTXP01ALATW.21.35.D02.1.454.CMB.2.raw
  modified_base (247)..(247): a, c, t, g, unknown or other
  misc_feature (247)..(247): n is a, c, g, or t
  modified_base (443)..(443): a, c, t, g, unknown or other
  misc_feature (443)..(443): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcactgggtccnccagactccgaggcgaagggctagagtggctggcagttatcgctattcgatggaagcgattagtgtactagtggcggtactccggtaggaaacgggccgtaacttccaactatccctaccgaaagaacgaactaattacccaaagaaccacgtcttgtttcagacaaatgagcagacctagaaagagagacacggntagtataagtaactggtcgacggacgtaacggtacctttaagttattagtcggttacgaacgggtaacctagtttacggacttacgggtcggggaccttaacggggacccttgggtaaccctaccggtcctcccgtcgaccggtcccttaacccgaaacccgg

SEQ ID NO: 354520 - DNA, 537 bp, Homo sapiens
  misc_feature: GZ8MTXP01A5FQN.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactcaggcaaggggctagagtggctggcagttatcgcattcgatggaagcgatatgtactatgcggactccgtgaaggccattcacatctccaagagaacaattccaaagacacgcttgtttctgacaaatgagacagacctaagaaacgaagacggacacggatagtatataactgagcgcgaggtaccttattactatggttacagggtaaccagttgacttacgtcggggaccaacgggacccttggtccaccgtctccctcgacctcccgttcccgaaccg

SEQ ID NO: 354521 - DNA, 598 bp, Homo sapiens
  misc_feature: GZ8MTXP01A1967.21.35.D02.1.454.CMB.2.raw
  modified_base (248)..(248): a, c, t, g, unknown or other
  misc_feature (248)..(248): n is a, c, g, or t
  modified_base (289)..(289): a, c, t, g, unknown or other
  misc_feature (289)..(289): n is a, c, g, or t
  modified_base (406)..(406): a, c, t, g, unknown or other
  misc_feature (406)..(406): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagacctccgaggcaaggggctagagtggctggcagttancgctattcgatggaagcatatgtactatgacggactccgtagaacgggccgtacttcacatcctaccaaagagaacaattacccaaagaacctacgtctgtttacagtacaaatganccagacctaagaaagaagagaccacggtctagtaatataaacgtgacgtcgacgtaacggtaacctttaatttaattaacgtggttaccgaagggtaacctagttacgacttacggtcggggaccacggggttaaccccttgggtaaccctaccgtcttacccctagacccgtcccgttaacccgaacccgg

SEQ ID NO: 354522 - DNA, 719 bp, Homo sapiens
  misc_feature: GZ8MTXP01AFN27.21.35.D02.1.454.CMB.2.raw
  modified_base (299)..(299): a, c, t, g, unknown or other
  misc_feature (299)..(299): n is a, c, g, or t
  modified_base (344)..(344): a, c, t, g, unknown or other
  misc_feature (344)..(344): n is a, c, g, or t
tcagtcgtcgctcgcacgaccggtgctcgatttagcacacgatagttgggtttgggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggaggtcggggggagcgtgttccagcctgggacgtcctgagagtctcctgtgcagcctctggattcagtcttcagtgtacttgccatgcacgtcgggtcccncagacctccgaggcgaaggggctaggaggtggctggctagttacncgactattcgatggaagcgataagtgtaactagtcggacggtactccggtagggaaacggggtcccaattcccgaacctactcccgtaccgaagaacgaaacctaacttaacccgaaaacgtaaaccgtaccgtcgtttaccggttttacaacgtaaccgtaaaagtaggaacgacgaacggaacccgtaaagggaaaaaggtaacggggaaacgggtaaaccgaaccggggttaacttaaagggttaaattaaaccgttacggttaggttaccgggaccggttacgggttaaaccgggtttaaaccttttaagtttaacggttttaaggtttacgggggtttaaccgtaaaccgggggttaaccctttaaaggg

SEQ ID NO: 354523 - DNA, 665 bp, Homo sapiens
  misc_feature: GZ8MTXP01D1S5P.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtgggtccnccagactccgaggcgaaggggctaggagtggctggctagttatcgctattcgatggaagcgaatatgtactagtgcgtactccgtagaacgggcctattccaacctatcctaccgaaagacgaactaaacttacccaaaaggaacctacgtctttagttttacctagtaactaaaagtgaacgacgaaacggtacccgtaaggaaaaggaaaggaacggaaaccgacgggtacttaggttaaattaattaaacgttggtacggacgtacggtaaacggttaacctttaatttaagttagtacggttacgaacggggtaacctaagtttacggaacgttacgggtacggggacccgttaacggggttacccttcggtaacctacccggtctcccgtcaccgtcccttaaccgaacccg

SEQ ID NO: 354524 - DNA, 685 bp, Homo sapiens
  misc_feature: GZ8MTXP01B2FPY.21.35.D02.1.454.CMB.2.raw
  modified_base (251)..(251): a, c, t, g, unknown or other
  misc_feature (251)..(251): n is a, c, g, or t
  modified_base (397)..(397): a, c, t, g, unknown or other
  misc_feature (397)..(397): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcggggggagcgtgttccagcctgggacgtccctgagagtctcctgtgcagcctctggattcagcttcagtgtactttgccatgcacgtgggtccncagacctcgaggcgaaggggctaggagtggctggctagttatcgctagttcgagtaggagcgtatagtgtactagtcggacgactccggtagaacgggcctacttccactatccctaccaaagacgaactaattaccaaagaaccncgtcttagtttacagactaaagtgaacgtaccaagtaccgtaaaggaaaacgaacggaacggaaccgaacgggtacttaaggttaattaacgttaacgtggtacgaccggtacgtaacgggttaaccttttaagttaagttacgttacgggttacgaacggggtaacccttaaggttccggtaaaccgttaccgggtcgggggaacccgaaccgggggttaaccccttggggtaacccctacccggttccttcccggacgttaccggtccccttaacccgaacccggg

SEQ ID NO: 354525 - DNA, 561 bp, Homo sapiens
  misc_feature: GZ8MTXP01CVA4W.21.35.D02.1.454.CMB.2.raw
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (343)..(343): a, c, t, g, unknown or other
  misc_feature (343)..(343): n is a, c, g, or t
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (369)..(369): a, c, t, g, unknown or other
  misc_feature (369)..(369): n is a, c, g, or t
  modified_base (550)..(550): a, c, t, g, unknown or other
  misc_feature (550)..(550): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtccgcagactccgaggcgaaggggctagagtggctggcagttancgnattcgagtggaagcgatatgtactagtgcgactcgtagacggcattcacntcncaagancaataccaaagacacgnttgttcagacaagtgagcacgactagaaagagacgacgacggactagtataagtacgtgtgaccgcgtaagtacctttaagtttactagttggttacgaagggaacctagttacgtacgttacgtcggggaccaacggggttcccttcggtaacctacccgtccttcccgcgaccgtcccncccgaacccgg

SEQ ID NO: 354526 - DNA, 892 bp, Homo sapiens
  misc_feature: GZ8MTXP01D02T6.21.35.D02.1.454.CMB.2.raw
  modified_base (250)..(250): a, c, t, g, unknown or other
  misc_feature (250)..(250): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgtactttgccatgcacgtgggtccncagactcgaggcgaagggctagagtggctggctagttatcgctattcgagtggaagtcgaattagtgtaactagtcggccggtacgttccggtaggaaacgggccgtaacttaccaaccgtaattcccgtaacccgaaaaggaacggtaacctaaaacgtttacccgaaaaaacggtaaaccctaccggttaccgtttacggtttttaaccctaggtaaacctaaaaaggttacggaaacggtaccgaaaacgggtaaccccgtttaaaaggggaaaaaacgggtaaacgggaaacggggaaaccgtaaccggggttaccgtttaaacgggtttaaaacgtttaaaacgtttaaacccggttaaggggttacgggtaacccgggtaacccgggttaaacggggtttaaaccccttttttaaaagttttaaaccgttttaaggggtttacggggttttaaaccggaaccgggggttaaaacccttaaggtttaacgggtaaacccggtttaaaccgggttacccggggggaaccccgttaaaccgggggttaaacccccgtttacggggttaacccctaacccggtttccccttaccccggtaccttacccgggtaaccccgttaaccccggaaaaccccggg

SEQ ID NO: 354527 - DNA, 655 bp, Homo sapiens
  misc_feature: GZ8MTXP01C0NIJ.21.35.D02.1.454.CMB.2.raw
  modified_base (292)..(292): a, c, t, g, unknown or other
  misc_feature (292)..(292): n is a, c, g, or t
  modified_base (308)..(308): a, c, t, g, unknown or other
  misc_feature (308)..(308): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcatgtgcagcctctggattcagcttcagtgtactttgccatgcacgtgggtccgccagacctccgaggcgaaggggctaggagtggctggctagttancgcattcgataggaancgtaatatgtaactagtcggcggtactccggaggaacgggcccctaattccactatccaaccaagaacgaactaaattacccaaagaacctcgtacttgtttacagaactaaaagtgaacgacgaagtaccgtaaggaaaacgaaggaaacggacgaaacggtacgttaggttaaacgtaacgttaaaccgtggttacgccggtaacggtaacggttaaacctttaagtttaagttagttcgggttacgaacggggttacttaagtttcgaacgttacggtcgggggaccgacgggttaacccgttcggtacctcccgtacctccgacctaaccgcccgtaaccccg

SEQ ID NO: 354528 - DNA, 658 bp, Homo sapiens
  misc_feature: GZ8MTXP01CC3RV.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagtcttcagtgtactttgccatgcacgtgggtccgccagacctccgagggtacgggacgtagaggtggctggcgtagttagtcgctattcgtagtaggaagacgatatgtactagtggtcggaccgtaccggtggaaacggggtccgtaacttcccacctatcctacccaagaaacgaactaacttaccaaaagaaaccaccgtcttacgtttctagaccaaaagtgaacgtcaacgacgtaaagaaaaggtagacggacacgtcttagtaaatagtaactggtacgaccggtagaacgttaccttttaagtttaagttagtcgggtactaacggggtacctaagtttcgaccgtaacggttcgggggacccaacggggttaacccttggttaccctaaccgtcccttctcgaccttacccgttaaccgaacccgtaacggg

SEQ ID NO: 354529 - DNA, 553 bp, Homo sapiens
  misc_feature: GZ8MTXP01AWJ9L.21.35.D02.1.454.CMB.2.raw
  modified_base (246)..(246): a, c, t, g, unknown or other
  misc_feature (246)..(246): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (370)..(370): a, c, t, g, unknown or other
  misc_feature (370)..(370): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtggtccncagactcgaggcaagggctagngtggctggcagtncgntatcgatggaancgatatgtacatgcggtactccgagaacggcctattcacatcaccaagacaacatccaaagacacgtctgttcngacaaatgagcagctagaaagacgagacacgctagtagtacgtatgtacgcgtcgacgtaccttatagttagtcggtacgaagggtaacctagttcgaacgttcggtacggggaccttaacgggttacccttcgggtaacctacccgttctaccgtcgttaacgtcccgttaaccgaacccgg

SEQ ID NO: 354530 - DNA, 603 bp, Homo sapiens
  misc_feature: GZ8MTXP01CAT6I.21.35.D02.1.454.CMB.2.raw
  modified_base (460)..(460): a, c, t, g, unknown or other
  misc_feature (460)..(460): n is a, c, g, or t
  modified_base (581)..(581): a, c, t, g, unknown or other
  misc_feature (581)..(581): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgcctatgcacgtcggggtccgccagacctccgaggcgaaggggctagagtggctggcagttactcgctattcgatggaagcgattatgtatagtggcggtactcggtagaacgggcctacgttccacctatcctacgaaagtacgaactaaacttacccaaagaaccacgtcttagtttctagaactaaagtgacgacaagacctaaaggaaagagaacggacaacggntaagtaataacgttaacgtgtacggcgaacgtaacgtactttaatattagtggttacgaggtaacctgttacgacttcggtacgggaccgttaacgggacccttggtcctaccgtctcccncgttacgcccttaacgaaccgg

SEQ ID NO: 354531 - DNA, 732 bp, Homo sapiens
  misc_feature: GZ8MTXP01EMN59.21.35.D02.1.454.CMB.2.raw
  modified_base (249)..(249): a, c, t, g, unknown or other
  misc_feature (249)..(249): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccnccagacctcgaggcgaaggggctaggagtggctggactagttatcgctagttcgataggaagcgtaatagtgtaactagtggaccggacttccggtaggaaacgggccgtacttaccaccgtattccaccgaaaagactaacgtaaacttacccgaaaagtaaccaccggttcgtttacgtttactacgaactaaagtcgaacgccgtaaacggtaccgtaaaggaaaaggaacgggaacggaaaccgtaacgggtacttagggttaaagttaacgttaaacggttcggtacggtaccggtaacggttaaacgggtttaacctttaaagttttaagtttaacggttacgggtttaaccgtaacgggggtaaacccttaggtttacgggaaccgtttaacggggcggggtaacccggaaccgggttacccgttacggtcccgtaccgtcctcccgtaccgaccgtccccgttaaccgaacccgg

SEQ ID NO: 354532 - DNA, 577 bp, Homo sapiens
  misc_feature: GZ8MTXP01C6QP2.21.35.D02.1.454.CMB.2.raw
  modified_base (251)..(251): a, c, t, g, unknown or other
  misc_feature (251)..(251): n is a, c, g, or t
  modified_base (292)..(292): a, c, t, g, unknown or other
  misc_feature (292)..(292): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggatttcagtcttcagtgtactttgccatgcacgtgggccncagacctcgaggcgaaggggctagagtggctggctagttancgcattcgatggaagcgatatgtactagtggcgactccgtaggacggcctattccactatcctaccaaagacaactaattacccaaagaacacgtcttgtttcagacaaatgagcagactaagaaagaagaggacaggtctagtaatataacgtgtagcgacgacgtactttaagttattagtggttacgaggtaactagttcgtacgttacggtacggggccaacgggttacccgttcggtcctacccgttcctcctccgaccgtccccttaacccgaacccgg

SEQ ID NO: 354533 - DNA, 517 bp, Homo sapiens
  misc_feature: GZ8MTXP01E1ZN2.21.35.D02.1.454.CMB.2.raw
  modified_base (495)..(495): a, c, t, g, unknown or other
  misc_feature (495)..(495): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaaggccgattcacatctccaagagaacaatccaagacacgctgtttctgacaaatgagcagcctagaaagaagaggactacggctgtatataactgtgcgcgaggaccttatatatggtcagggaaccattgacttacgtggggccagggaccccttggtccaccgtcncctcacgtcccttccgaacccg

SEQ ID NO: 354534 - DNA, 597 bp, Homo sapiens
  misc_feature: GZ8MTXP01B0H06.21.35.D02.1.454.CMB.2.raw
  modified_base (292)..(292): a, c, t, g, unknown or other
  misc_feature (292)..(292): n is a, c, g, or t
  modified_base (412)..(412): a, c, t, g, unknown or other
  misc_feature (412)..(412): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcacgtgggtccgccagacctccgaggcgaaggggctagagtggctggcagttancgctattcgatggaagcgatatgtactatgcggactccgtagaacggaccgtattccactatcctaccaaagagaactaacttacccaaagaacctacgtcttgtttacagacaaatgancagacctagaaagagagacacggactagtaatactaacgtgacgcgacgaggtacctttattagttagtggttacgacgggtaacctagttacgacgttacggtcggggacccgttaacggggttaccccttcgggtaacccacccggttcctcccgtcgaccgtccccttaacccgaacccggg

SEQ ID NO: 354535 - DNA, 616 bp, Homo sapiens
  misc_feature: GZ8MTXP01CZV74.21.35.D02.1.454.CMB.2.raw
  modified_base (254)..(254): a, c, t, g, unknown or other
  misc_feature (254)..(254): n is a, c, g, or t
  modified_base (295)..(295): a, c, t, g, unknown or other
  misc_feature (295)..(295): n is a, c, g, or t
  modified_base (299)..(299): a, c, t, g, unknown or other
  misc_feature (299)..(299): n is a, c, g, or t
tcagtcgtcgctcgcacgaccggtgctcgatttagcacacgatagttgggtttggggggaaggaggaagactgacggtcctgccacgaggtggtgctgggcacggtgggcactcgacacaaccatttgcgctccactgtcaggtccacctggtggagtcgggggagcgtgttccagcctgggacgtccctgagagtctcctgtcgcagcctctggattcagtcttcagttgactttgccatgcacgtgggtccncagactcgaggtcgaaggggctagagtggctggctagttancggntattcgataggaaagcgtatagtgtactagtggacggtactccggtaggacggggtcctagttccaccgtatcctacccgaaagtacgaacaaacttaccaaagactacgctgtttacagactaaagtgaacgcgaagacgaagaaagaaggacggttacaggtataggtaataataacgttgacgacgcgtacggttactttattacttagtggttaccaagggtaacctagttcgacgttaacggtcgggaccgttacgggttacccttcggtaaccctaccggtcctacccgtcgacctccgttccgaacccgg

SEQ ID NO: 354536 - DNA, 687 bp, Homo sapiens
  misc_feature: GZ8MTXP01EYNHE.21.35.D02.1.454.CMB.2.raw
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtcctgagagtctcctgtgcagcctctggattcagtcttcagtgtactttgcctatgcacgtgggtcccgccagacctccgaggcgaaggggctaggagtggctggctagttancgntagttcgagtggaagcgtatattgtaactagtcggaccggtactccggtagggaaaccggggtcctaacttacccgacctattcccaccgaaagacaacctaaacttacccgaaaagaccctacgtcttcggtttacagaactaaagtggaacgacgaacgtaccgtaaaggaaaacggaaacggaaggaccgtacgggtacttaaggtaacttaacgttaaacgttggtacgcggtaacggtaacggttaacctttaagttaagttagttcggtaacgacgggtaaccttaggttacgacgttacggacgggggaacccttacggggttacccgttggtaacccaccggttcttcccgacgaccggtccccttaaccgaaccccggg

SEQ ID NO: 354537 - DNA, 704 bp, Homo sapiens
  misc_feature: GZ8MTXP01C278E.21.35.D02.1.454.CMB.2.raw
  modified_base (294)..(294): a, c, t, g, unknown or other
  misc_feature (294)..(294): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccgccagacctccgaggacgaaggggctaggagtggcgtggctagttancgatagttcgagtggaagcgtattagtgtactagtcggacggtacgtccgtaggaacggcctacttccaacctntaccnccgaaaagacaacctaactaccgaaagacacgtcttagttccagaactaaagtgagacgtaacggactaaagggaaaagaacggaacgggacgtacggtacttaaggttaattaaacgtaaacgttggacggaccggtaaccgggtaaacgttaaccgtttttaagttaacgtttaacggttacgggtttaccgggaaagggtaaccctttaagttacgggtaaaccgttacgggtaaccgggggccttaaaaccgggggttaccccttggggtaacccctacccggtcttaccccgcgttaacccggtccccgttaaccgaaaccccggg

SEQ ID NO: 354538 - DNA, 654 bp, Homo sapiens
  misc_feature: GZ8MTXP01B109H.21.35.D02.1.454.CMB.2.raw
  modified_base (251)..(251): a, c, t, g, unknown or other
  misc_feature (251)..(251): n is a, c, g, or t
  modified_base (293)..(293): a, c, t, g, unknown or other
  misc_feature (293)..(293): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgccatgcacgtcgggtccnccagacctccgaggcgaaggggctagagtggctggcagttancgctagttcgatggaagcgtaatataggtactagtcggacggtacctccggtaggaaacggggccgtaacttccgaactatccctaccgaaagaagtaaccaaatttacccgaaacgaactaccgtctttgtttacctagacaaatgagacagaccgtaagaaacgaagacggacacggtactagttaataattaacgtgtacggcgacgtaacgtacgtttaatttagtagtcggttacagggtaacctagttacgaacgttacggtacggggaccgttaaaccggggttacccttacggttaacccgtacccggttcccttcccgccgttaccgtaaccccgttaacccgtaaacccgg

SEQ ID NO: 354539 - DNA, 686 bp, Homo sapiens
  misc_feature: GZ8MTXP01BSS4M.21.35.D02.1.454.CMB.2.raw
  modified_base (256)..(256): a, c, t, g, unknown or other
  misc_feature (256)..(256): n is a, c, g, or t
  modified_base (303)..(303): a, c, t, g, unknown or other
  misc_feature (303)..(303): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcggggggaggcgtgttccagcctgggacgtccctgagagtctcctgtgcagcctctggattcagtcttcagtgtactttgcctatgctacgtcgggtccnccagacctccgagggcgaagggggctaggaggtggctggctagttancgctagttcgagtggaagcgaattatgtactagtcggcggtactcggtaggaacggcctacttccactatccaccgaagaactaactaaacttacccgaaagtaaccacgtctttagtttactagtacaaaagttggaacgacaacggtaccgaaaggaaaacggaacggaacggaacgacggtattaggtaaattaacgtaaacgtggtacggacggtacgtaaacggttacctttaaagttagttaaggttacggttacgagggtaacctagttacggtacgttacgggtaccgggggtaccgttaaacggggttacccgttacgggtccctaccccggtcttaccccgcgttacccgaacccgttaaccccgaacccggg

SEQ ID NO: 354540 - DNA, 706 bp, Homo sapiens
  misc_feature: GZ8MTXP01D9Y9Z.21.35.D02.1.454.CMB.2.raw
  modified_base (251)..(251): a, c, t, g, unknown or other
  misc_feature (251)..(251): n is a, c, g, or t
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgtactttgccatgcacgtgggtccnccagactccgaggcgaaggggctaggngtggctggcagttacncgctattcgatggaagcgtaatagtgtaactagtcggacggtacgttccggtaggaacgggccgtaacttccaaccgtatcctacccgaaagaacgtaacctaaacttacccgaaaacgtaaccgtacgtcttcgggttttactagaactaaagtgagaccgtagaccgtaagaaagaaggacggaacgacggtacttaggtaacttaacgtaacgttggtaacggccggtaacggtacggtttaaacctttaagtttaacgttagttacgggttacgaacggggtaacctagttacggtaaccgttacgggtacgggggtaacccgaacgggggttaccccttcggggtaaccctaaccccggttcctaccccgtaccgttaaccggtccccttaacccggtaaccccggg

SEQ ID NO: 354541 - DNA, 586 bp, Homo sapiens
  misc_feature: GZ8MTXP01EG4S5.21.35.D02.1.454.CMB.2.raw
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (556)..(556): a, c, t, g, unknown or other
  misc_feature (556)..(556): n is a, c, g, or t
  modified_base (566)..(566): a, c, t, g, unknown or other
  misc_feature (566)..(566): n is a, c, g, or t
tcagtcgtcgctcgcacgaccggtgctcgatttagcacacgatagttgggtttggggggaagaggaagactgacggtcctgccacaggtggtgctgggcacggtgggcactcgatacaacatttgcgctccactgtcaggtccacctggtggagtcgggggaggcgtgttccagcctgggacgtccctgagagtctcctgtgcagcctctggattcagcttcagtgtactttgccatgctacgtcgggtccgccagacctccgaggcgaaggggctaggagtggctggctagttancgntattcgagtggaagcgatatagtactagtgcgtactccgtaggaacggcctacttcacagtccaccaaagacgaactaaacttaccaaagacactcgttgtttacagaactaaagtgaagcagaccgtaagaaaagaagacggacacggactagtaataagtaacgtgtacgcgaagtacgtactttaattattagtacgttcgaacggtaactagttagtacgttacggcgggacgacggttaccgttcgtaaccnccgtctcccncgacgtcccttcgaacccgg

SEQ ID NO: 354542 - DNA, 582 bp, Homo sapiens
  misc_feature: GZ8MTXP01AHPA1.21.35.D02.1.454.CMB.2.raw
  modified_base (248)..(248): a, c, t, g, unknown or other
  misc_feature (248)..(248): n is a, c, g, or t
  modified_base (446)..(446): a, c, t, g, unknown or other
  misc_feature (446)..(446): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtcccncagactccgaggcaaggggctagagtggctggcagttatcgctattcgatggaagcgatatgtactatggcggactccggtagaacggccgacttcacatctaccaaagacgaacaattacccaaagaaccacgtcttgtttcagacaaatgagcagacctagaaacgagaggacgacgctagtatataactgagcgngacggtacttattattagtggttacagggtaacctgtttacgacgttacggtcgggacccgaacggggttaacccttcgggtaacccgtacccggttccttacccgtacgaccgtccccgttaaccgtaaacccgg

SEQ ID NO: 354543 - DNA, 554 bp, Homo sapiens
  misc_feature: GZ8MTXP01AUK2K.21.35.D02.1.454.CMB.2.raw
  modified_base (247)..(247): a, c, t, g, unknown or other
  misc_feature (247)..(247): n is a, c, g, or t
  modified_base (519)..(519): a, c, t, g, unknown or other
  misc_feature (519)..(519): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagactccaggcaaggggctagagtggctggcagtatcgcattcgatggaagcgatatgtactagtgcggactccgtgaacgggccattcacctatcctaccaagacgaacaattaccaaagaacacgtcttgtttctagacaaatgagacagacctagaaagaaggagacacggactagtatataacgtgtgcgcgaggtacttattattataggtcagggaactagttgacttacggtggggaccgttacgggttacccttacggtccnccgttccgtccgtcgacgtcccgttccgaacccgg

SEQ ID NO: 354544 - DNA, 553 bp, Homo sapiens
  misc_feature: GZ8MTXP01DKHE0.21.35.D02.1.454.CMB.2.raw
  modified_base (296)..(296): a, c, t, g, unknown or other
  misc_feature (296)..(296): n is a, c, g, or t
  modified_base (334)..(334): a, c, t, g, unknown or other
  misc_feature (334)..(334): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggagcgtgttccagcctgggacgtccctgagagtctcctgtgcagcctctggattcagcttcagtgacttgccatgcactggtccncagctccaggcaaggggctaggagtggctggcagttancgcattccgatggaagcgataagtgtaactagtgacggactccggtagaaacgggccgattcacatctaccagagactaactaccaaagaacacgcttagtttacgtgactaaagtcgagacagaccgtaagaaagaagaggacacggctagttatattaacgtgtgcgcgacggtaaccttagtttaacttgtaggtttacgaacgggttaacctaag

SEQ ID NO: 354545 - DNA, 596 bp, Homo sapiens
  misc_feature: GZ8MTXP01D88PC.21.35.D02.1.454.CMB.2.raw
  modified_base (250)..(250): a, c, t, g, unknown or other
  misc_feature (250)..(250): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgtactttgccatgcacgtgggtccnccagacctcgaggcgaaggggctagagtggctggctagttatcgctattcgatggaagcgatatgtactagtggcggtactccgtaggaacgggcctaattccactatcctaccgaaagacgaacaaattacccaaagaaccacgtcttgtttcagacaaatgagcagactagaaagagagacacggtactagtaatataacgtgtgcgacgtagtactttaattattagtgttacgagggtaacctagttcgacgttacggtacggggaccgaacggggttacccgttggtaacccgtacccggttcctcccggtacttaccgtccccgttaacccgaaacccgg

SEQ ID NO: 354546 - DNA, 673 bp, Homo sapiens
  misc_feature: GZ8MTXP01DJG6Z.21.35.D02.1.454.CMB.2.raw
  modified_base (250)..(250): a, c, t, g, unknown or other
  misc_feature (250)..(250): n is a, c, g, or t
  modified_base (277)..(277): a, c, t, g, unknown or other
  misc_feature (277)..(277): n is a, c, g, or t
  modified_base (295)..(295): a, c, t, g, unknown or other
  misc_feature (295)..(295): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccactggtggagtcgggggagcgtgttccagcctgggacgtccctgagagtctcctgtgcagcctctggattcagtcttcagtgtactttgccatgcacgtcgggtccnccagactccgaggcgaaggggctaggngtggctggactagttacncgactattcgagtggaagtcgtaattagtgtactagtggccggtactccggaggaacgggcctactccactatccctaccgaaagaacgaactaaacttacccaaaagaactacgtctttgtttacagtaactaaagtgaacgtaccaagtaccgtaaaggaaaaggaacggacggaaaccgacggtattaggttaagttaaacgttaacgtgtacggacgtacggtaggttaacctttaagtttagttagttacggtacgaacgggtaactagttacggtaaccgttacggtacgggggtacccgttaacggggttacccgttcggtaacccgtacccgtcctcccgtaccaccgtccccgttaacccgaacccggg

SEQ ID NO: 354547 - DNA, 665 bp, Homo sapiens
  misc_feature: GZ8MTXP01A0FK8.21.35.D02.1.454.CMB.2.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttancgnattcgatggaagcgatatgtactatgcggactccggtgaaacggggccgtacttccaccgtatccctacccgaaagtaacgaactaaacttacccaaaaggaaacctacggtcttagttttaccctacgacctaaaagtggaacgacctaagacccgtaaggaaaaggaacgaacgggaaccaacgggtacttaggttaaattaacgtaaaccgttgggtacggtacccgacggtaacggttaaccttttaaagttaagtttaaacgttgggttaccgaagggggtaaccctaagttacggacgttacgtcgggggtacccacggggttacccttgggtcccaccggtcctcctcgacgtcccttccgaacccgg

SEQ ID NO: 354548 - DNA, 811 bp, Homo sapiens
  misc_feature: GZ8MTXP01BK4JB.21.35.D02.1.454.CMB.2.raw
  modified_base (290)..(290): a, c, t, g, unknown or other
  misc_feature (290)..(290): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgcctatgctacgtgggtccgcagactcgaggcgaagggctaggagtggctggctagttancgctattcgatggaagcgtaattagtgtactagtcggaccggtacttccggtaggaaacggggtcccgtactttaccgaacctagttcccgtacccgaaaagggaacaacctaaacgtttaaccccgaaaagggtaacctaccggtcgttttacgggttttacctacgaaactaaaaggtggaaacggtaccgaaacggtacccgtaaaggaaaaggtaaacgggaacggaaacccgaaccgggtacgtttaagggttaaattaaacggttaaaccggttgggttacggaacccggtacggaaacggtttaaacccttttaaggttttaacgtttaagggttacgggttaaccgtaaacgggggtaacccttaaggtttaccggtaaaccggtttaacggggttaccggggggaaccccttaaaccggggggttaaccccgttcgggggttaacccctaccccgggttcccttaccccgtaccggacccgtaacccccgttaacccggtaaaaccccgggg

SEQ ID NO: 354549 - DNA, 746 bp, Homo sapiens
  misc_feature: GZ8MTXP01BE77Y.21.35.D02.1.454.CMB.2.raw
  modified_base (299)..(299): a, c, t, g, unknown or other
  misc_feature (299)..(299): n is a, c, g, or t
  modified_base (343)..(343): a, c, t, g, unknown or other
  misc_feature (343)..(343): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggagcgtgttccagcctgggacgtccctgagagtctcctgtgcagcctctggattcagcttcagtgacttgccatgcacgtgggtcccncagacctccgaggcgaagggggctaggagtggcgtggcagttancgctagttccgagtggaagcgaataatgtaactagtgggaccgggtaaccgttccggtaggaaacgggggtcccgtatttaccgaaccctattcctacccgaaggtaacgtaacctaaaacgttacccgaaaacgtaaaccgtaaccggtaccgtttacgttttaccgtacggtaaacctaaaacgttaggaacggtaccaacggtacccgtaaagggaaaaacgggtaaagggaaaccggggaaccgaaaccggggtaaccgttaaggttaaagttaaacgttaaaaccgttgggttaaccgggaccgggttaaccgggttaaacggggttaaccccttttaagtttaacgttttaagggttacggggtttacccggtaaacggggttaacccgtttaaggg

SEQ ID NO: 354550 - DNA, 748 bp, Homo sapiens
  misc_feature: GZ8MTXP01B1FOU.21.35.D02.1.454.CMB.2.raw
  modified_base (250)..(250): a, c, t, g, unknown or other
  misc_feature (250)..(250): n is a, c, g, or t
  modified_base (295)..(295): a, c, t, g, unknown or other
  misc_feature (295)..(295): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggactccctgagagtctcctgtgcagcctctggattcagtcttcagtgactttgcctatgcacgtcgggtccnccagactccgaggcgaaggggctaggaggtggctggactagttanccgactagtttcggagtaggaagcgtaattaagttagtaacctagttcgggaccggtaccttacccgggtaggaaaccgggggtccctaacttcccaacctagtcccctacgaaaagaacgtaaccttaaacgttaacccgaaaaggtaaacctacgttacgttagtttaccctagaactaaaagtcggaacgacgtagtacccgtaaaggaaaaggaacggaacggaaccgtaacgggtacttaaggttaaacgttaacgttaaacggtcggtaacggtaccggtaccggtaaacggtttaaccgtttaatttaaggttaacgttacggttaccggaagggtaacccttaaggttacggtacgttacggtaccggggaccgttaaccgggttaaccgttcgggtaaccacccggttcctcccgtacgacccgtcccgttaaccgaacccggg

SEQ ID NO: 354551 - DNA, 683 bp, Homo sapiens
  misc_feature: GZ8MTXP01ERLKF.21.35.D02.1.454.CMB.2.raw
tcagtcgtcgctcgcacgaccggtgctcgatttagcacacgatagttgggtttggggggaagaggaagactgacggtcctaccacaggtggtgctgggcacggtgggcactcgacacaacatttgcgctccactgtcaggtccacctggtggaggtcggggggaggcgtgttccagcctgggacgtccctgagagtctcctgtgcagcctctggattcagtcttcagtgtactttgccatgcacgtgggtccgcagacctccgaggcgaaggggctaggagtggctggcagttactcgctattcgagtgggaagcgtaattatgtaactatcggcggtacgtccggtaggaacgggccgtattccccaacctatcctaccaaggaaacaactaacttaccaaaaggaaacctacgtcttggtttacagtacaaaagtcggaagacgacgtaccgtaaagaaaaggaacggaacgggaacgacggtattagtaaattaacggttaaacgtggtacggacgaacggtaacgttaacctttaatttaagttagttacgggttactaacgggggtaacctaagtttacggacgtaacgggttcggggtaaccgaacggggttaacccttcgggttaccctaaccgtccgtaacctcaccggttccctaacccgaaccgtaacccggg

SEQ ID NO: 354552 - DNA, 631 bp, Homo sapiens
  misc_feature: GZ8MTXP01EWXB9.21.35.D02.1.454.CMB.2.raw
  modified_base (252)..(252): a, c, t, g, unknown or other
  misc_feature (252)..(252): n is a, c, g, or t
  modified_base (291)..(291): a, c, t, g, unknown or other
  misc_feature (291)..(291): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccactggtggagtcggggggagcgtgttccagcctgggacgtcctgagagtctcctgtgcagcctctggattcagtcttcagtgtactttgcctatgctacgtcgggtccncagctcgaggcgaagggctagagtggctggctagttacncgatagttcgagtaggaacgtcgtaattacgtaggttaactagttcggaccggtaccgttccggtaaggaaccggggtacctacttaccaacctagttccctaacccggaaaagaacgaactaactaacgaaacggactaccgtcttgtttaccagtactaaagtgaacgtaccaaggttaccaaaggaaacggaggaacgacgtacggtatagtaattaacgtagtgacgacgagtagtactttaattagtgttaggtacgcggtaactagttcgaacgttcgggcggaaccgttaacggccgttagccgtactcctctacgacttccgaaccgaacgg

SEQ ID NO: 354553 - DNA, 854 bp, Homo sapiens
  misc_feature: GZ8MTXP01DX83H.21.35.D02.1.454.CMB.2.raw
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccaccgtggtggaggtcgggggagcgtgttccagcctgggacgtcctgagagtctcctgtgcagcctctggattcagtcttcgaagttcgtacttcgaccctagttcgaccgtaaccggttcgggggttacccccgacccgaacggtaaccccgttaccccggaaacggggtaccggaaaacggggggtcccttaaagggaagggtttacggggcccgtttggggggaccttaaggttttaacgtcccggacttaaacggttttaccccgggaaaggtttaggggaaaacggtccgttaaagtttaaagttacggtttaaccgttaaaggttcccggggtaacccggggttaaccgttaccccggggttaaggggaaaaccgggggtccccgttaaactttacccgaaccctaacgttaccgttacccgaaaggtaaaccgtaaaccgtaaaactttaaccccgaaaagtaaaccgtaaccggtctttacggtttaacgacgtaaacgtaaagtcgaacgaccgaacggaccgtaaaggaaacggtaaagaacgaacgtacggtaacttaagttaacttaaattaacggtggtacgaccgttacggttaacggttaactttaagttaagtttacggtaggttacgtaacgggaaccttaagg

SEQ ID NO: 354554 - DNA, 638 bp, Homo sapiens
  misc_feature: GZ8MTXP01C3Q2K.21.35.D02.1.454.CMB.2.raw
  modified_base (250)..(250): a, c, t, g, unknown or other
  misc_feature (250)..(250): n is a, c, g, or t
  modified_base (293)..(293): a, c, t, g, unknown or other
  misc_feature (293)..(293): n is a, c, g, or t
  modified_base (296)..(296): a, c, t, g, unknown or other
  misc_feature (296)..(296): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcacgtgggtccnccagactccgaggcgaaggggctaggagtggctggctagttancgntattcgatggaagcgattatgtactagtggacggtactccggtaggaacggggcctacttccactatccctaccaaagacaactaaacttacccgaaagaaccacgtcttgtttcagacaaagtgagcagacgtaaggaaagaaggacggacacggtactagtaattaaacgtaacgtgtacggacgtacggtaacggtacctttaagttagttagttaggtaccgaagggtaacctagttacggtaacgttacgggtacggggacccgttaaacggggttcccttacggggtccctacccggttctacccgtacgaccggtccccttaacccgaacccggg

SEQ ID NO: 354555 - DNA, 578 bp, Homo sapiens
  misc_feature: GZ8MTXP01DU7DU.21.35.D02.1.454.CMB.2.raw
  modified_base (255)..(255): a, c, t, g, unknown or other
  misc_feature (255)..(255): n is a, c, g, or t
  modified_base (297)..(297): a, c, t, g, unknown or other
  misc_feature (297)..(297): n is a, c, g, or t
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
  modified_base (352)..(352): a, c, t, g, unknown or other
  misc_feature (352)..(352): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagtcttcagtgtactttgccatgctacgtcgggtcccncagacctcgaggcgaaggggctaggagtggctggctagttancgntattcgatggaancgattatgtactgtgcggtactcgagacggctactcacntcacaagacaacaatacaaagacacgtcttgttacagaacaatgananacgtacgaagaaagaggagacgacgtatagtaataactagtgtacggacgacgtaacgttaactttaagttagttacgttaggttacgaagggtaacctgttacgtaacgttacggcgggacttaaccgggttcttcggtaacctaccgtctccgagaccctccgttaaccgaaccgg

SEQ ID NO: 354556 - DNA, 544 bp, Homo sapiens
  misc_feature: GZ8MTXP01ETY26.21.35.D02.1.454.CMB.2.raw
  modified_base (247)..(247): a, c, t, g, unknown or other
  misc_feature (247)..(247): n is a, c, g, or t
  modified_base (391)..(391): a, c, t, g, unknown or other
  misc_feature (391)..(391): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtgaagggccgattcacatctccaagacgaacaaattccaaagaacacgtctgttcagtacaaatgancagacctagaaagagagacacggactagtaattataacgtagtcgcgcgacgtactttaattattatgttcgagggaacctagttgacttacgtggggccacgggttacccttggtcctacccggtctccctcacggtcccttcccgaacccg

SEQ ID NO: 354557 - DNA, 789 bp, Homo sapiens
  misc_feature: GZ8MTXP01EJGQ0.21.35.D02.1.454.CMB.2.raw
  modified_base (252)..(252): a, c, t, g, unknown or other
  misc_feature (252)..(252): n is a, c, g, or t
  modified_base (295)..(295): a, c, t, g, unknown or other
  misc_feature (295)..(295): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacattttgcgctccactgtcaggtccacctggtggagtcggggggagcgtgttccagcctgggacgtccctgagagtctcctgtgcagcctctggattcagcttcagtgtactttgccatgcacgtcgggtccncagacctcgaggcgaaggggctaggagtggctggactagttancgctatttcgagtcggaagcgtattagtgtaactagtcggaccggtacttccggtaggaaacggggcctaacgttccaacctatccgtacccaaaggaacgtaactaactttaacccgaaaacggtaacccgtaccgttacgtttacggtttttacccagtaaacgtaaaaagtcgggaaacgaccgtaacggtaaacccgtaaagggaaaaaacggaacgggaaacggaaccgtaaccgggttacttaaaggttaaagttaaacgttaaacggttggttaccgggaacggtaaacccggttaaacgggtttaaaccttttaaaggttttaagtttaacgggtttacggggtttacccgaaaggggtaaacccctttaaggtttaccggtaaacgtttaacgggaccgggggtaacccgttaaaccggggttcccgtttacggcccgtaccgttaaccgttccgacgaccgtccccgttaacccgaaacccggg

SEQ ID NO: 354558 - DNA, 668 bp, Homo sapiens
  misc_feature: GZ8MTXP01BZ6J6.21.35.D02.1.454.CMB.2.raw
  modified_base (251)..(251): a, c, t, g, unknown or other
  misc_feature (251)..(251): n is a, c, g, or t
  modified_base (295)..(295): a, c, t, g, unknown or other
  misc_feature (295)..(295): n is a, c, g, or t
  modified_base (488)..(488): a, c, t, g, unknown or other
  misc_feature (488)..(488): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccactggtggaggtcgggggagcgtgttccagcctgggacgtcctgagagtctcctgtgcagcctctggattcagtcttcgagtgtactttgcctatgcacgtcgggtccncagacctcgaggcgaaggggctaggagtggctggactagttacncgactagttcgagtaggaagcgtaattagtgttaactagtcggacggtacttcggtaggaacgggtctaacttccaactatacctaccgaaagaacaactaaacttaaccgaaagtaacctacgtcttagtttacagtaactaaagtgaacgacaacgaccgtaaggaaaacggaaggaacggacgaacggtnttaagtaacgtaaagttaacgtgacggacgtacgtaacggttacctttaagtttagtacgtcggttacgagggtaaccttagttcggaacgttacgggtacggggacccttaacgggttaccttcggtaacccacccggttcctacccgaccgaccggtccccttaacccggaaacccgg

SEQ ID NO: 354559 - DNA, 617 bp, Homo sapiens
  misc_feature: GZ8MTXP01ES6F2.21.35.D02.1.454.CMB.2.raw
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcacgtcgggtccgccagactcgaggcgaaggggctagagtgctggctagtancgnattcgatggaagcgatatgtatagtgcgactcgtaggacggcgacttcacatcctcaaagagaactaataccgaaagacctacgtcttagtttcagactaaatgaagcgaagaccgtaagaaaacggaagaacggacacggtactagtaataagtaacgtgtacgccggtacgaaggttacctttagttagttagttacgttcggaacgggtaactagttacggtaccgttaacgggtcgggggaacccgacggggttaccccgttacggtaacccgtacccggttcctcccgtccgaccgtccccgttaacccgaaacccggg

SEQ ID NO: 354560 - DNA, 790 bp, Homo sapiens
  misc_feature: GZ8MTXP01CSWQH.21.35.D02.1.454.CMB.2.raw
  modified_base (251)..(251): a, c, t, g, unknown or other
  misc_feature (251)..(251): n is a, c, g, or t
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggactccctgagagtctcctgtgcagcctctggattcagtcttcagttgactttgcctatgcacgtgggtccnccagacctccgaggcgaaggggctaggagtggctggcagttancgntattcgatggaagcgatatgtactagtcggacggtactccggtaggaacgggcctaacttccaacgtactacccgtacccgaaaaggtaacgtaacctaaactttaacccgaaaaacggtaacccgtaaccggttacctttacggtttacctaacggtaacctaaaaagttcgggaaacgtaccgtaaacggtaacccgttaaagggaaaaacggaaacgggaaacgggaaacccgtaacgggtaaccgttaaggttaaacggttaaacgttaaaccggttcggtaccggacggtaaccggtaaacggttaaccttttaaagtttaagttaaggttacggtttaccgaaacggggttaacccttaaggtttacggtaaaccgtttaccgggtaccgggggtacccgttaaaccggggttacccgttacgggttaacccgacccggttccttccccgtaccgaacccgttccccgttaacccgtaaaccccggg

SEQ ID NO: 354561 - DNA, 512 bp, Homo sapiens
  misc_feature: GZ8MTXP01BW1D1.21.35.D02.1.454.CMB.2.raw
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
  modified_base (341)..(341): a, c, t, g, unknown or other
  misc_feature (341)..(341): n is a, c, g, or t
  modified_base (347)..(347): a, c, t, g, unknown or other
  misc_feature (347)..(347): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (421)..(421): a, c, t, g, unknown or other
  misc_feature (421)..(421): n is a, c, g, or t
  modified_base (446)..(446): a, c, t, g, unknown or other
  misc_feature (446)..(446): n is a, c, g, or t
  modified_base (494)..(494): a, c, t, g, unknown or other
  misc_feature (494)..(494): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcactgggtccgccagactccgaggcaaggggctaggagtggctggcagttatcgcattcgatggaagcgatatgtactatgcgactcgngaaggcatcacntcncaagancaatccaaagacacgntgttcngacaaatgagcagactagaaagagagactagctagtatataacgtgcgacgngagtacttatatatggtcaggaacngttgacttcgtaggggccaggggacccttgggtcctaccgtctccgtnaccgtccttcccaaccgg

SEQ ID NO: 354562 - DNA, 733 bp, Homo sapiens
  misc_feature: GZ8MTXP01ESMWS.21.35.D02.1.454.CMB.2.raw
  modified_base (251)..(251): a, c, t, g, unknown or other
  misc_feature (251)..(251): n is a, c, g, or t
  modified_base (277)..(277): a, c, t, g, unknown or other
  misc_feature (277)..(277): n is a, c, g, or t
  modified_base (292)..(292): a, c, t, g, unknown or other
  misc_feature (292)..(292): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgtactttgccatgcacgtgggtccncagactccgaggcgaaggggctaggngtggctggcagttancgctagttcgagtggaagcgatagtgtactatggacggtactccggtaggaaacgggccgtacttccgactacgtcctaccgaaaaggacgtaactaaacttaacccgaaaacgtaaacctaaccgtctttacggttttactacggaactaaaacgtggaacgtaccgaacggaaccgtaaaggaaaaaggaaacggaaacgggaaccgaaacgggtacgttaaggttaaagttaaacgttaaacggttcggtaggaccggtacggtaaacggttaaccttttaaagtttaagtttaacggttcgggtttaacgaacggggtaaccttaagttacgtaaacgttacgggtacgggggtaccccgttaacggggttaaccccgttcgggtaaccctacccggttcctcccgtaccgaccgtccccttaacccgtaaccccgg

SEQ ID NO: 354563 - DNA, 593 bp, Homo sapiens
  misc_feature: GZ8MTXP01BUZXC.21.35.D02.1.454.CMB.2.raw
  modified_base (272)..(272): a, c, t, g, unknown or other
  misc_feature (272)..(272): n is a, c, g, or t
  modified_base (296)..(296): a, c, t, g, unknown or other
  misc_feature (296)..(296): n is a, c, g, or t
tcagtcgtcgctcgcacgaccggtgctcgatttagcacacgatagttgggtttgggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggagcgtgttccagcctgggacgtccctgagagtctcctgtgcagcctctggattcagcttcagtnacttgccatgcacgtcgggtcccnccagacctccgaggcgaagggggctaggacgtggctggctagttatcgcagttccgagtggaagctataatgtaactagtgcggactccggtaggaaacgggcccattccacctatcctacccaagacgaactaaacttacccaaagaaccacgtcttacgtttcgtacgactaaagtgaacgcagaccgtaagaaacgaaggacggacacgggctagttaataagttaacgttgacgacggttcgacggttaaccttagttaatttacgtgggtttaccgaagggttaaccctaag

SEQ ID NO: 354564 - DNA, 643 bp, Homo sapiens
  misc_feature: GZ8MTXP01BT92Z.21.35.D02.1.454.CMB.2.raw
  modified_base (250)..(250): a, c, t, g, unknown or other
  misc_feature (250)..(250): n is a, c, g, or t
  modified_base (329)..(329): a, c, t, g, unknown or other
  misc_feature (329)..(329): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgtattttgcctatgcactgggtccncagactccaggcgaaggggctaggagtggctggcagttatcgcattcgagtggaagcgatatgtactagtgcgactcgngaaggccgacttcacatctccaaagacgaactaaactacccgaaagaacacgtcttacgtttacacgaacaaagtgaaacgcgaagtaccgtaaggaaaagaaggaaggaaccaacgggtacttaggttaaataaacgttaacgtggtacggacggaccgtacggtaaccttttaaagtttattagttacggttaccgaagggtaacccttagttacggacttacgggacggggtacccgttaacggggttaccccttagggtaaccctacccggtctcccgtaccgttaccggtccccttaaccgaaccccgg

SEQ ID NO: 354565 - DNA, 698 bp, Homo sapiens
  misc_feature: GZ8MTXP01BIGMU.21.35.D02.1.454.CMB.2.raw
  modified_base (251)..(251): a, c, t, g, unknown or other
  misc_feature (251)..(251): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctggggcgtccctgagagtctcctgtgcagcctctggattcagtcttcagtgtactttgccatgcacgtgggtccnccagactccgaggcgaaggggctaggagtggctggctagttancgctattcgagtggaagcgtaatagtgtactagtcggcggacttccggtaggaacgggccgtaacttaccaacctatccctaccgaaagaacgtaactaaacttacccgaaagaacctacgtcttacgtttacagaactaaatcggaacgacgaacgtaccgtaaggaaaaggaacggaacggaacgacgggtacttaggtaacttaagttaaaccggtggtcggaaccggtacggtaacggttaaccttttaagtttaagttacggttacgggttaaccgtaaggggtaaccttaggttacgtaaccgttacgggtaccggggtaccgttaacgggttaacccgttcgggtaaccctacccggttcctacccgtacgaccgtccccgttaacccgtaacccgg

SEQ ID NO: 354566 - DNA, 549 bp, Homo sapiens
  misc_feature: GZ8MTXP01A9HR0.21.35.D02.1.454.CMB.2.raw
  modified_base (248)..(248): a, c, t, g, unknown or other
  misc_feature (248)..(248): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (314)..(314): a, c, t, g, unknown or other
  misc_feature (314)..(314): n is a, c, g, or t
  modified_base (352)..(352): a, c, t, g, unknown or other
  misc_feature (352)..(352): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (385)..(385): a, c, t, g, unknown or other
  misc_feature (385)..(385): n is a, c, g, or t
tcagtcgtcgctcgcacgaccggtgctcgatttagcacacgatagttggggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctcgtggattcagcttcagtgactttgccatgcactgggtccncagactccaggcaaaggggctagagtggctggcagtatccganatnagtgaagcgatatgtactangcggactccgagaacggctactcacatcgtacaaaganaacaatacaagaacacgctgttctganaaananagacgagacgtagaaagaaagaagaacgacgactagtagtaataactagtagacgacgagaacgttaacttaattaagtagtacgaggaacgtaacgttagtacgttacgtacggtacggacggaccgttacgtcgtacgtcgtcctcacgtccgccgtaaccg

SEQ ID NO: 354567 - DNA, 698 bp, Homo sapiens
  misc_feature: GZ8MTXP01CADVP.21.35.D02.1.454.CMB.2.raw
  modified_base (253)..(253): a, c, t, g, unknown or other
  misc_feature (253)..(253): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggactccctgagagtctcctgtgcagcctctggattcagtcttcagtgtactttgccatcgctacgtcgggtccnccagacctccgaggcgaagggggctaaggaggtggctggctagttancgntagttcgagtggaagcgtatagtgtactagtcggcggtactccgtaggaacgggtcctacttccactatccctaccgaaagaacgtaactaaacttacccgaaaagaacctacgtcgtttacgtttactacgtaactaaagtcggaacgtaccgaacgtaacccgtaaaggaaaaacggaaacggaacggaaccgtaacgggtacttaaaggttaaacttaaacgttaacgtaggtacgaccggtaacgtaacggttaacctttaaagttagttagtacggttacgaacgggtaactagttacgaacggttcggtacgggaccgttaaacgggttcccgttacggtccctaccgttccgtacccgtacgacccgtcccgttaacccgaacccggg

SEQ ID NO: 354568 - DNA, 658 bp, Homo sapiens
  misc_feature: GZ8MTXP01ACXUU.21.35.D02.1.454.CMB.2.raw
  modified_base (249)..(249): a, c, t, g, unknown or other
  misc_feature (249)..(249): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtgggtccncagactcgaggcgaaggggctaggagtggctggctagttacncgntagttcgagtggaagcgtatagtgtactagtcggacggtacgtcggaggaacgggtcctactaccactactcctacgaaagacgaactaacgtaccaaagtacctacgtcttacgtttacgacgtaactaaagtcgaacgacgtaaaggtaccgtaaaggaaaacggaaacgggaacggaacgtaacggtacgttaagtaaacttaagttaacgtggtacggacgtacggtaacgttaactttaattagttagtaggtacgacggtaactagttcgtaacgttacggtacggggaccgacgggttacccgttcggtaaccctaccgttccgtacctacgacccgtcccgttaacccgaacccgg

SEQ ID NO: 354569 - DNA, 797 bp, Homo sapiens
  misc_feature: GZ8MTXP01AMCSV.21.35.D02.1.454.CMB.2.raw
  modified_base (272)..(272): a, c, t, g, unknown or other
  misc_feature (272)..(272): n is a, c, g, or t
  modified_base (289)..(289): a, c, t, g, unknown or other
  misc_feature (289)..(289): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccgcagactcgaggcgaagggctagngtggctggctagttacncgtctattcgtagtggaagtcgtaatatgtactagtcggcggtacgttcggtaggaacgggtccgtacttccacctatccctaccgaaaggaacgtaacctaaacgtttaccccaaaaggtaaacccgtaccggtccgtttacggttttacccgtagtaaaccgtaaaaggttacggaaccggtaccgaaacggttaccccggtaaaagggaaaaacgggtaaaacggggaaccgggtaaacccgaaccgggggttaccttaaacggttaaaggttaaacgttaaacggttcgggtaccggaccggtaacggtaaacgggttaacccttttaaagtttacgttacggttagggttaaccgaacgggggtaaccctaaggtttacggaaccctttaaacgggggtccgggggtaacccgttaccgggggttaaccccgttcgggtaaccccctacccgggttccttccccgtacccgaccggtaacccccttcccggtaaaccccgggg

SEQ ID NO: 354570 - DNA, 683 bp, Homo sapiens
  misc_feature: GZ8MTXP01BLUG4.21.35.D02.1.454.CMB.2.raw
  modified_base (253)..(253): a, c, t, g, unknown or other
  misc_feature (253)..(253): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagtcttcagtgtactttgccatgcacgtcgggtcccncagactccgaggcgaaggggctagagtggctggctagttancgctattcgagtaggaagcgtaatatgtactagtggacggtactccggtaggaacgggccgtacttccactatcctaccgaaaggaacaacgtaacttacccgaaagaaccacgttcttggtttcagaactaaagtcggaacgaccgaacggaccgtaaagggaaaacgaacgggaacggaaccgacggggtactttaaggttaaacgttaaacgtttaaccggtggttaccgggaccgtacggtaacggttaccttttaaagttagttaggtacggttacgaacggggtaacctggttacgaaccgttacgggaccggggaccgttaacgggttacccttgggtaacccaccggttcctcctacgaccgtcccgttaaccgaacccgg

SEQ ID NO: 354571 - DNA, 547 bp, Homo sapiens
  misc_feature: GZ8MTXP01AYUU7.21.35.D02.1.454.CMB.2.raw
  modified_base (246)..(246): a, c, t, g, unknown or other
  misc_feature (246)..(246): n is a, c, g, or t
  modified_base (285)..(285): a, c, t, g, unknown or other
  misc_feature (285)..(285): n is a, c, g, or t
  modified_base (344)..(344): a, c, t, g, unknown or other
  misc_feature (344)..(344): n is a, c, g, or t
  modified_base (371)..(371): a, c, t, g, unknown or other
  misc_feature (371)..(371): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactccaggcaaggggctagagtggctggcagttancgcatttcgatggaagcgatatgtactatgcgactccgtgaagggccattccacatccncaagacgcaatccaagacagctgttcngacaaatgagcagcctagaaagagagacacggctagtatataactgagtcgcgaaggtaccttaattaagttatacggttccaagggtaaccctagttacgaacttacgtacggggaccacggggttaacccttgggtaaccaccgtccgtccctcgacgtcccgttccaacccgg

SEQ ID NO: 354572 - DNA, 540 bp, Homo sapiens
  misc_feature: GZ8MTXP01EZDWO.21.35.D02.1.454.CMB.2.raw
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
  modified_base (350)..(350): a, c, t, g, unknown or other
  misc_feature (350)..(350): n is a, c, g, or t
  modified_base (386)..(386): a, c, t, g, unknown or other
  misc_feature (386)..(386): n is a, c, g, or t
  modified_base (515)..(515): a, c, t, g, unknown or other
  misc_feature (515)..(515): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccnccagactccgaggcaaggggctagagtggctggcagttancgcattcgatggaancgatatgtactatgcgactccgagaacggcatcacatctcaaaganaacaatccaaagacacgcttgttcagacaaatgacnagactagaaagagacgacacggctagtaatactaactgtagcgacgaacgtacttattatagtcgttacgaggaacctgttagacttaggcggggtacccaaggggttacccttgggtaacaccgttcnccctcaccgtcccttaaccgaaccg

SEQ ID NO: 354573 - DNA, 611 bp, Homo sapiens
  misc_feature: GZ8MTXP01DYI9S.21.35.D02.1.454.CMB.2.raw
  modified_base (250)..(250): a, c, t, g, unknown or other
  misc_feature (250)..(250): n is a, c, g, or t
  modified_base (290)..(290): a, c, t, g, unknown or other
  misc_feature (290)..(290): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcacgtgggtccncagactcaggcgaaggggctaggagtggctggctagttancgctattcgagtggaagcgaattatgtactagtcgcggactccgtaggaagggcctattccacatcctaccaaagacgaacaaattaccaaagaaccacgtcttgtttactagactaaagtcgaagcgaacgtaccgtaaggaaaagaaggaacggacgacggacttagtaataagtaacgttgacgcgacgtaacgtactttattattagtggttacgaagggtaactagttcgtacgttacgggtcgggaccgaaacggggttcccttcggtaacctacccgtcctccctacgttaccgtcccgttaacccgaacccgg

SEQ ID NO: 354574 - DNA, 756 bp, Homo sapiens
  misc_feature: GZ8MTXP01DY6AU.21.35.D02.1.454.CMB.2.raw
  modified_base (255)..(255): a, c, t, g, unknown or other
  misc_feature (255)..(255): n is a, c, g, or t
  modified_base (298)..(298): a, c, t, g, unknown or other
  misc_feature (298)..(298): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtcctcctgtgcagcctcgtggtattcagtcttcagtgtactttgccatgacacgtcgggtccnccagactccgaggcgaaggggctaggagtggctggctagttancgctagttacgagtggaagtcgtaattagtaggtactaggtcggaccggtaccttaccggagggaaacgggcccgtacttaccccaactacttcccgaacgaaaggaaccgtaataaactacccgaaaaagaccgacgtctttcgggttacctaggtaaactaaagtcggaagtaccgtaaacggtaacccgtaaaggaaaaccggaaaggaacgggaacccgtacggtattacggttaaattaaacgtaacgttgggtaccgaccggtaacggttaacggtttaacctttaagttaagtttacgttacggggttaaccgaaggggtaaaccttagttacgggtaaacccggtttcgggacgggggtaacccgttaaaccgggttccccgttacggggttaacccaccccgttccgtaaccccgtcgaacccgtcccgttaaccccgaaaacccgggg

SEQ ID NO: 354575 - DNA, 625 bp, Homo sapiens
  misc_feature: GZ8MTXP01EI06V.21.35.D02.1.454.CMB.2.raw
  modified_base (252)..(252): a, c, t, g, unknown or other
  misc_feature (252)..(252): n is a, c, g, or t
  modified_base (298)..(298): a, c, t, g, unknown or other
  misc_feature (298)..(298): n is a, c, g, or t
  modified_base (417)..(417): a, c, t, g, unknown or other
  misc_feature (417)..(417): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagttgactttgccatgcacgtggggtcccnccagacctccgaggcgaagggggctaggaggtggctggacagttancgctatttcgagtggaagcgtatatgtactagtggcggactccggaggaacgggcctattccacatctaccaaagacaactaaattccaaagacacgtcttagtttctagacaaatgancagtacgaagaaagagagacacggtatagtaatagtaacgtgtacggacgacgtaagttactttaatttacgttagttacggttacgaacgggtaacctagtttcggaaacgtttacggcgggggtaacccgttaacgggttacccttcgggtaaccctaccggttccttcccgtacgaccgtaaccccgttaacccgaaaccccggg

SEQ ID NO: 354576 - DNA, 696 bp, Homo sapiens
  misc_feature: GZ8MTXP01CWWCT.21.35.D02.1.454.CMB.2.raw
  modified_base (251)..(251): a, c, t, g, unknown or other
  misc_feature (251)..(251): n is a, c, g, or t
  modified_base (295)..(295): a, c, t, g, unknown or other
  misc_feature (295)..(295): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtacttgccatgcacgtcgggtcccnccagacctccgaggcgaaggggctaggagtggctggactagttncgctagttcgagtggaagcgtatatgtactagtcggacggactccggtaggacgggtaccgtacttacccgaacctacgtccctaccgaaaacggtactaacctaaactttacccgaaaagtaaccctaccggttactttacggtttacaacggtaactaaagtcggaacgacgaaaccggtaccgtaaagggaaaacggaaacgggtaacggaaccgtaacggtaccgttaagttaacgtaaacgttaacgtggtacggacgtacgtaacgttaacctttaagttatacgtaggttcgaacgggtctaagttcgtaacgacggtcggggacccgttaacgggttcccttcgggtaacccacccgtctacccgtcgacccgtcccgttaacccgaacccgg

SEQ ID NO: 354577 - DNA, 678 bp, Homo sapiens
  misc_feature: GZ8MTXP01DDLEP.21.35.D02.1.454.CMB.2.raw
  modified_base (245)..(245): a, c, t, g, unknown or other
  misc_feature (245)..(245): n is a, c, g, or t
  modified_base (262)..(262): a, c, t, g, unknown or other
  misc_feature (262)..(262): n is a, c, g, or t
  modified_base (306)..(306): a, c, t, g, unknown or other
  misc_feature (306)..(306): n is a, c, g, or t
  modified_base (333)..(333): a, c, t, g, unknown or other
  misc_feature (333)..(333): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgcttcttttaagaggtgtccactgtcaggtccaccgtggtggaggtcggggggagcgtgttccagcctgggacctcctgagngtctcctgtgcagcctntggattcgagtcttcagtgtacttgccatgacacgtgggtcccncagacctccgaggcaagggggctaggngtggctggctagttatcgactagtttcccgagttaggaacgcgtataacgtagttaactagtcgggacccgggtaccgttcccggtagggaaacggggtccccgtattaccgtaacctagtcctccgaaagaacgtaactaaacgttacccaaagaaaccgtacgtacgttcggtttactacgaactaaacgttggaacgccgtaagacccgttaaaggaaacgtaaaggaacggaccaaccggggttaatagttaagttaaacgttacgtaggtcgacggttcggttaacgttaaccttttaagttaagtttacgtgggttaccgtaacgggttaaccttaagg

SEQ ID NO: 354578 - DNA, 624 bp, Homo sapiens
  misc_feature: GZ8MTXP01BZA5Y.21.35.D02.1.454.CMB.2.raw
  modified_base (252)..(252): a, c, t, g, unknown or other
  misc_feature (252)..(252): n is a, c, g, or t
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagtcttcagttgtactttgtcatgcacgtgggtccncagactccgaggcgaaggggctaggngtggcgtggcagttancgnattcgataggaagcgtattatgtactagtcggacggacttccggtaggaacgggcctacttccactagtcctaccgaaagacgaactaaacttaaccgaaagtaccacgtcttcgtttactcgaactaaagtgaacgacaacgtaccgtaaaggaaaagacggaaacggaacgacgggtacttaggtaaactaagttaaccggtgtacggaccgtacgtaacggttaactttagttagttacgtagttacggaaggtaacctagttcgacgttaggcgggacacgggttccttggcctcctcgcctcgaccgtccttccgaacccgg

SEQ ID NO: 354579 - DNA, 599 bp, Homo sapiens
  misc_feature: GZ8MTXP01D14LJ.21.35.D02.1.454.CMB.2.raw
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtcgggtccgccagactccgaggcgaaggggctaggagtggcgtggctagttactcgactagttcgagtaggaagcgtatagtgtactagtgcggtactcggagaacggctactccacatctaccaaagacgaactaaacttaccaaagaaccacgtcttagtttctagtaacaaagtgacgacaaggaccgtaagaaagaaggaggacgacggactagtaataagtaacgtgtacgacggagtaacgtactttattattagttcggtacgagggaactagttcgtacttacggtcgggaccttacgggttaccttgggtcctaccgtcctcctcgaccgtccttaaccgaacccgg

SEQ ID NO: 354580 - DNA, 667 bp, Homo sapiens
  misc_feature: GZ8MTXP01CS1U1.21.35.D02.1.454.CMB.2.raw
  modified_base (248)..(248): a, c, t, g, unknown or other
  misc_feature (248)..(248): n is a, c, g, or t
  modified_base (289)..(289): a, c, t, g, unknown or other
  misc_feature (289)..(289): n is a, c, g, or t
  modified_base (305)..(305): a, c, t, g, unknown or other
  misc_feature (305)..(305): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagacctccaggcaaggggctagagtggctggctagttancgcattcgagtggaancgatatgtactatcggcgactccgtaggaacggccgtacttccaccgatccctaccgaaagacgaactaaacttacccgaaagaaccaccggtctttcgtttactacgtaacaaaacgtggaacgaccaacggtacccgtaaagggaaaacggaaaggaacgggaaccgaacgggtacgttaaggttaaattaacgttaaacgttggtacggacccggtacggaacggttacctttaagtttaagtttaacgtcgggtttaaccgaaggggtaaccctagttacggtaacgttcggttacggggccgaacgggttacccgttcgtaaccgaccgtctcccgtcaccgtcccttccgaacccg

SEQ ID NO: 354581 - DNA, 652 bp, Homo sapiens
  misc_feature: GZ8MTXP01CDN9K.21.35.D02.1.454.CMB.2.raw
  modified_base (287)..(287): a, c, t, g, unknown or other
  misc_feature (287)..(287): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccgccagactcaggcaaggggctagagtggctggctagtancgctattcgatggagcgatatgtactatgcgactcgtagaacggcgtacttcacatcctaccgaagacgaactaaacgttacccaaagtaaccacgtaccgtttgtttacctagactaaaatcgaacgacaaggacccgtaaggaaaagagggaagtaacgacgggtactaaggttaactaacgttaacgtagtacggaccggtacggaacgggttacctttaaagttattaaggtcggttacaacggggtaactaagttaggtaaccgttaggtacggggacccgttaacggggttaacccgttcggggtaacctacccggttctccccgtacgttaaccgtcccgttaacccgaaaccccggg

SEQ ID NO: 354582 - DNA, 615 bp, Homo sapiens
  misc_feature: GZ8MTXP01ANQ9B.21.35.D02.1.454.CMB.2.raw
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
  modified_base (373)..(373): a, c, t, g, unknown or other
  misc_feature (373)..(373): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccncagactccgaggcaagggctagagtggctggcagttancgcattcgatggaagcgatatgtactagtcggcggactcggaggaacggcctattccacatcctacaagacaacaataccaaagacncgtactgtttacngactaaatgacncaagaccgtaaggaaaagacgaggacacggtctaggtaataacgtaacgtgtaggaccgagtaacggtacctttaagtttagttaagtacggttacgaacgggtaacctagtttacggaaaccgttacgggtaccgggggaccttaacggggttacccgttcgggtaaccctacccggttcgtacccctacgaccgccccgttaaccgaaacccggg

SEQ ID NO: 354583 - DNA, 669 bp, Homo sapiens
  misc_feature: GZ8MTXP01BGY4D.21.35.D02.1.454.CMB.2.raw
  modified_base (305)..(305): a, c, t, g, unknown or other
  misc_feature (305)..(305): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagtcttcagttgtactttgcctatgcacgtcgggtccgccagacctccgaggcgaaggggctaggagtggcgtggctagttactcgntagttcgagtaggaagcgtaatagtgtactagtggcggtactccggtaggaacgggcctaactccacctatccaccgaaagaacgaactaaactaaccgaaagaaccacgtcttgtttactgaactaaagtgacaccgtaagacccgtaaaggaaaacgaaggaacggaaccgaaccggtattaaggttaaataagttaacgtggtacgacggtacgtacggttaactttaagtttagtacggtaggttacgaggtaacctgttacgacgttacgggtacgggaccgttaacggggttacccgttggtaacccgtaccccggttcttccccgacgaccccgtcccgttaacccgaaacccccgg

SEQ ID NO: 354584 - DNA, 675 bp, Homo sapiens
  misc_feature: GZ8MTXP01CPNKH.21.35.D02.1.454.CMB.2.raw
  modified_base (255)..(255): a, c, t, g, unknown or other
  misc_feature (255)..(255): n is a, c, g, or t
  modified_base (302)..(302): a, c, t, g, unknown or other
  misc_feature (302)..(302): n is a, c, g, or t
  modified_base (369)..(369): a, c, t, g, unknown or other
  misc_feature (369)..(369): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagtcttcagtgtactttgccatgctacgtcgggtcccnccagacctccgaggcgaaaggggctaggagtggcgtggactagttancgactagttcgagtggaagcgtatagtgtactagtgacggtactcggtagacggcctacttccactntcacaagaacaactaaactaccaaagacctacgtcttagtttccagaactaaagtgacgacaacgtaccgtaaaggaaaacggaaaggaacggaaccgaacgggtacttaagtaagttaactttaaacggtgtacggaaccggtacgtaacggttaacttttaagttaagttacgttacggtacgaacgggtaaccttaggttcgtaaacgttacgggtacgggtacccgttaaacggggttaccccttacgggtaacccctaccggttcctcccgtacacccggtccccttaacccggaacccgg

SEQ ID NO: 354585 - DNA, 572 bp, Homo sapiens
  misc_feature: GZ8MTXP01E2C5A.21.35.D02.1.454.CMB.2.raw
  modified_base (249)..(249): a, c, t, g, unknown or other
  misc_feature (249)..(249): n is a, c, g, or t
  modified_base (292)..(292): a, c, t, g, unknown or other
  misc_feature (292)..(292): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (547)..(547): a, c, t, g, unknown or other
  misc_feature (547)..(547): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccnccagacctccgaggcgaaggggctagagtggctggctagttancgctattcgatggaagcgatatgtactagtggcggactcgtaggaacggcctacttcactatcncaaganaacaataccaaagacacgtcttgttcagacaaatgagcagaccgtaaggaaagaaggacgacacggactagtaataataacgtgcgacgacgaagtactttattagttagtcggtacgaagggtaactagttcgacgttacggtcggggaccacgggttacccttggtaaccacccgttctcccncgaccgtcccgttaaccgaacccgg

SEQ ID NO: 354586 - DNA, 585 bp, Homo sapiens
  misc_feature: GZ8MTXP01AIP9E.21.35.D02.1.454.CMB.2.raw
  modified_base (250)..(250): a, c, t, g, unknown or other
  misc_feature (250)..(250): n is a, c, g, or t
  modified_base (291)..(291): a, c, t, g, unknown or other
  misc_feature (291)..(291): n is a, c, g, or t
  modified_base (386)..(386): a, c, t, g, unknown or other
  misc_feature (386)..(386): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtcccncagactccgaggcgaaggggctaggagtggctggcagttancgctagttcgatcggaagcgatagtgtactagtggcgtactccggtagaacgggcctattccacatcctacaaagacgaactaataccaaagacncgtctgtttacngacaaatganacagacctagaaagaagagacacggtctagtaatataacgtgagcgacgtaggtactttaagttattagtgttacgaggtaacctagttcgacgttacggtcggggaccaacggggttacccttgggtaaccctaccgtccttcccgaccgttacgtccccgttaacccgtaacccg

SEQ ID NO: 354587 - DNA, 539 bp, Homo sapiens
  misc_feature: GZ8MTXP01BUY8F.21.35.D02.1.454.CMB.2.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (379)..(379): a, c, t, g, unknown or other
  misc_feature (379)..(379): n is a, c, g, or t
  modified_base (513)..(513): a, c, t, g, unknown or other
  misc_feature (513)..(513): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggactccctgagagtctcctgtgcagcctctggattcagcttcagtgactttgccatgcacgtgggtccncagactccgaggcaaggggctagagtggctggcagttancgctattcgatggaagcgatatgtactagtggccgactcgtaggaacggccattccacatctaccaagacgaacaaattcccaaagtaaccncgtctttgttctgacaaatgagacagacctagaaagagagacacgctagtagtactaagtgtgcgacgagtacgttattatagtgtcgaggtaacctattgacttacggtcgggccgaggttacccttggtccncgtctcctcgacgtccttcgaacccg

SEQ ID NO: 354588 - DNA, 642 bp, Homo sapiens
  misc_feature: GZ8MTXP01AJI8M.21.35.D02.1.454.CMB.2.raw
  modified_base (249)..(249): a, c, t, g, unknown or other
  misc_feature (249)..(249): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtcgggtccnccagactccgaggcgaaggggctaggagtggctggctagttancgntattcgatggaagcgatatgtactagtggcgactccggtaggaacgggcctacttccactatcctccaaagacaactaatacccaaagaaccacgtcttgtttctagactaaagtgaacgacgagtaccgtaaggaaaacggaaggaacgggaaccgaacgggtacttaaggtaagttaagttaaaccggtggtacggacggtacgtaacggttaacctttaagttaagttagttacggttacgaagggtaacctaagtttcgaaacgttacggtcggggaaccgacggggttacccttcggggtccctaccgttctccctacgaccgtcccttaaccgaacccggg

SEQ ID NO: 354589 - DNA, 580 bp, Homo sapiens
  misc_feature: GZ8MTXP01EQ1WR.21.35.D02.1.454.CMB.2.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (474)..(474): a, c, t, g, unknown or other
  misc_feature (474)..(474): n is a, c, g, or t
  modified_base (558)..(558): a, c, t, g, unknown or other
  misc_feature (558)..(558): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagactccaggcaaggggctagagtggctggcagttancgcattcgatggaagcgatagtgtactagtggcggtactccggtaggaaacggggcccgtaatttccacctagtccctcccgaaaagacgtaactaaacttacccgaaaagaaccacgtcgttgtttactagacaaatgagacagacctagaaagaagagacacggatagtaatataacgtgtgcgngaacgtacttatagttataggtcaggtaactagttgacgttacggtcggggaccgacgggacccttggtaaccacccgtctccncgaccgtcccttccgaacccgg

SEQ ID NO: 354590 - DNA, 568 bp, Homo sapiens
  misc_feature: GZ8MTXP01EVEF8.21.35.D02.1.454.CMB.2.raw
  modified_base (250)..(250): a, c, t, g, unknown or other
  misc_feature (250)..(250): n is a, c, g, or t
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
  modified_base (388)..(388): a, c, t, g, unknown or other
  misc_feature (388)..(388): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtcgggtccnccagacctccgaggcgaaggggctaggagtggctggctagttancgctattcgatggaancgatatgtactagtgcggtactccgtaggaacggccattccactatcctaccaagagaactaataccaaagacacgtnttgtttcagacaaagtgagcagtaccgtaagaaacgagaaggacacggtactagtaataataagtgtgacgacgtagtactttattattgtaggtcgaggtaactagttgacgttacggtgggaccgacgggttaccttcggtccaccgttctccgtcgacgtcccgttaaccgaaccgg

SEQ ID NO: 354591 - DNA, 637 bp, Homo sapiens
  misc_feature: GZ8MTXP01AP5X9.21.35.D02.1.454.CMB.2.raw
  modified_base (252)..(252): a, c, t, g, unknown or other
  misc_feature (252)..(252): n is a, c, g, or t
  modified_base (293)..(293): a, c, t, g, unknown or other
  misc_feature (293)..(293): n is a, c, g, or t
  modified_base (491)..(491): a, c, t, g, unknown or other
  misc_feature (491)..(491): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcggggggaggcgtgttccagcctgggacgtccctgagagtctcctgtgcagcctctggattcagcttcagtgtactttgccatgcacgtgggtccnccagactccaggcgaaggggctaggagtggctggctagttncgctattcgagtggaagcgatatgtactagtgcggactcggtagaacgggcctacttcactagtcctaccgaagaacgaactaaactacccaaagaacctaccgtcttcggtttacctagactaaaagtggaacgacaacgaccgtaaggaaaaggaaggacggaacgacggtactagtaactataacgtgtacgcgngtaacgtaacctttaagttattacgttaggttacgagggtaacctagtttacgaacgttacggtcgggggaacccacggggttaacccgttcgggtccctacccggtccttacccgacgacccgtccccgttaacccgaacccggg

SEQ ID NO: 354592 - DNA, 610 bp, Homo sapiens
  misc_feature: GZ8MTXP01BC17Z.21.35.D02.1.454.CMB.2.raw
  modified_base (249)..(249): a, c, t, g, unknown or other
  misc_feature (249)..(249): n is a, c, g, or t
  modified_base (291)..(291): a, c, t, g, unknown or other
  misc_feature (291)..(291): n is a, c, g, or t
  modified_base (306)..(306): a, c, t, g, unknown or other
  misc_feature (306)..(306): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccnccagactccgaggcgaaggggctaggagtggctggcagttancgcattcgatggaancgatatgtactagcgacggactccggtaggaaacggggcctaattccaactatcctacccgaaagaacgaactaaacttacccgaaaggaaccacgtctttagttttcagtacaaatgagacagaccgtaagaaagaagacggacgacggactagtaagtataacgtgtagacggacgtaggtacttaattagttagtaggttcgagggtaactagttacggtacgttacggtacggggaccgttaacgggttaccgttacgggtcctacccgttctcctacgaccgtcccttcccgaacccgg

SEQ ID NO: 354593 - DNA, 559 bp, Homo sapiens
  misc_feature: GZ8MTXP01CXPOR.21.35.D02.1.454.CMB.2.raw
  modified_base (247)..(247): a, c, t, g, unknown or other
  misc_feature (247)..(247): n is a, c, g, or t
  modified_base (349)..(349): a, c, t, g, unknown or other
  misc_feature (349)..(349): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtagaaggccattcacatctcaaganaacaattccaaagaacacgtcttgtttctgacaaatgagcagacctagaaagaagagacacggctagtatataactgtacgcgcgaggtaccttattattagtggttcaggggtaacctagttcggtacttacggtcggggccgttaacggggttacccttcgggtcccacccgttcctcccgtccgacgtccccgttcccgaacccggg

SEQ ID NO: 354594 - DNA, 751 bp, Homo sapiens
  misc_feature: GZ8MTXP01CJYMG.21.35.D02.1.454.CMB.2.raw
  modified_base (261)..(261): a, c, t, g, unknown or other
  misc_feature (261)..(261): n is a, c, g, or t
  modified_base (279)..(279): a, c, t, g, unknown or other
  misc_feature (279)..(279): n is a, c, g, or t
  modified_base (304)..(304): a, c, t, g, unknown or other
  misc_feature (304)..(304): n is a, c, g, or t
  modified_base (329)..(329): a, c, t, g, unknown or other
  misc_feature (329)..(329): n is a, c, g, or t
  modified_base (347)..(347): a, c, t, g, unknown or other
  misc_feature (347)..(347): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgaccttgggttttcctcgttgcttcttttaagaggtgtccactgtcaggtccaccgtggtggaggtcggggggagcgtgtccagcctgggactcctgagagtctcctgtgcagcctntggattcagtcttcagtntacttgccatgcacgtcgggtcccncagctccgaggcgaaggggctaggngtggctggactagttacncgactagttaccgagtaggaagtcgtaattaattagtaacgtagttgggtacggtaccgtccgggaagggaaacgggtacccgtacttcccgaaaccctacttaccgtaacccgaaggtaaacgtaaacctaaaacgtttaaccccgaaaaaggaaaccctaaccggttcgtttaacgttttaccggaaaggtaacctaaaaagttcgggaaacgtacccgaacggtaacccgtaaaagggaaaaacggtaaagggaaccgggaaccgtaaccggggtaactttaacggttaaattaaacgttaaacgttagggtacggttaccgggttacggttaacgggtttaacccttttaatttaacgtttaggttacgggttaacggtaaccggggttaaccttaacgg

SEQ ID NO: 354595 - DNA, 605 bp, Homo sapiens
  misc_feature: GZ8MTXP01CCRFB.21.35.D02.1.454.CMB.2.raw
  modified_base (251)..(251): a, c, t, g, unknown or other
  misc_feature (251)..(251): n is a, c, g, or t
  modified_base (438)..(438): a, c, t, g, unknown or other
  misc_feature (438)..(438): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagtcttcagtgactttgcctatgcacgtgggtccnccagactcgaggcgaaggggctaggagtggctggctagttatcgactagttcgagtaggaagcgtaatagtgtactagtggaccggtacttccggtaggaaacggggcctaacttccaacgtatcctacccgaaagacgaactaaacttacccgaaagaaccacgtcttacgttcagacaaagtgancagaccgtaagaaagagagacgaggctagtatatacgtgtacgcgtacgagttacttaagttattaagttgttacgaagggaacctagttacgacgttacggtacgggcacggggttacccttcggtaacctaccgtcctcccgtcgacgtcccgttaaccgaaccg

SEQ ID NO: 354596 - DNA, 618 bp, Homo sapiens
  misc_feature: GZ8MTXP01AVF7V.21.35.D02.1.454.CMB.2.raw
  modified_base (207)..(207): a, c, t, g, unknown or other
  misc_feature (207)..(207): n is a, c, g, or t
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctntggattcagcttcagtgactttgccatgcacgtgggtccncagactccgaggcaaggggctagagtggctggcagttancgcattcgatggaancgatatgtactatgcgactccgtagaacggccattcacatcctccaaagacaacaaattaccaaagaacctacgtcttagtttctacgacaaaatgaagcaagacctaagaaaagaagaaggaacacggactagtaataagtaaactgtacgacgcgaggtacctttaattattaacgtaggttacaaggggtaaccctaagtttacggaccttaaaccggttcgggggaacccaacgggggttaaaccccttcggggtaaccctaacccggtaacttaccccgtaccgaccggtcccttaacccgaaaaccccggg

SEQ ID NO: 354597 - DNA, 773 bp, Homo sapiens
  misc_feature: GZ8MTXP01D05GF.21.35.D02.1.454.CMB.2.raw
  modified_base (251)..(251): a, c, t, g, unknown or other
  misc_feature (251)..(251): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgccatgcacgtcgggtccncagacctcgaggcgaagggctaggagtggctggactagttacncgctagttcgagtggaagcgtaattagtgtactagtcggacgtacctccggtaggaaacgggcccgtaattcccaaactactccctacccgaaagaacgtaacctaaactttaacccgaaaacgtaaaccctaccgtcgtttacggttttacctaggtaacctaaaagtcggaacgaccgaacgtacccgtaaagaaaaggaaacgggaacgggaaaccgaacgggtaaccttaggttaaacgttaaacgtaaaccgttaggtacgtaaccggtaccggttaaacggttaaccctttaaagtttaactttaaggttacggttaaccggaaacggggttaaccctaaggttaaccgtaaaccggttacgggtaccgggggtaacccgttaaaccgggggttaaccccgttacgggtaaccccgtaaccccggttcctccccgtaccgacccgtaaccccgttaaccccgtaaaccccggg

SEQ ID NO: 354598 - DNA, 599 bp, Homo sapiens
  misc_feature: GZ8MTXP01EHFC7.21.35.D02.1.454.CMB.2.raw
  modified_base (251)..(251): a, c, t, g, unknown or other
  misc_feature (251)..(251): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgctacgtgggtcccnccagacctcgaggcgaaggggctaggagtggctggcagttatcgctattcgagtggaagcgaatatgtactatgacgtactccgaggaacgggccacttccacatcctacgaaagagaaccaattacccaaagaccacgtcttgtttacagacaaagtgagtacgaagtaccgtaaaggaaagacggaagacgacgtactagtaataatacgtgtacgcgacgtacgtacttattattagtgtacgaggtaactgttcgacgttacggtcgggacccgttaacgggttacccgttcggtaacccgacggttccctcccgtacgaccgtcccttaaccccgaacccggg

SEQ ID NO: 354599 - DNA, 589 bp, Homo sapiens
  misc_feature: GZ8MTXP01C5OUL.21.35.D02.1.454.CMB.2.raw
  modified_base (249)..(249): a, c, t, g, unknown or other
  misc_feature (249)..(249): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtgggtccnccagactccgaggcgaaggggctaggagtggctggctagttancgnattcgatggaagcgatatgtactatggcggtactcgtaggacggcctattccactatccacccgaaagacgtaactaaattacccaaagaacacgtcttacgttactagactaaaagtgaacgcgtaacggacctaaggaaaagaaggaacggaacacgggtactaggtaacttaaagtaacgtggtcgacgaccgtaagtacctttatattagtgtacgaggaactagttgacttacggtgggccacgggaccttggtaaccacgtctcctacgaccgtccttccgaacccgg

SEQ ID NO: 354600 - DNA, 550 bp, Homo sapiens
  misc_feature: GZ8MTXP01AXN5H.21.35.D02.1.454.CMB.2.raw
  modified_base (193)..(193): a, c, t, g, unknown or other
  misc_feature (193)..(193): n is a, c, g, or t
  modified_base (252)..(252): a, c, t, g, unknown or other
  misc_feature (252)..(252): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagngtctcctgtgcagcctctggattcagtcttcagtgactttgccatgcacgtgggtcccncagacctcgaggcgaaggggctagagtggctggcagttancgntattcgatggaagcatatgtactatcggcggactccgtggaacggccattccacatcctccaaagacgaacaaattcccaaagacacgtcttgttcagacaaatgagcagactagaaagagaggacacggtctagtaatataacgtgtacgcgtacgagtacctttagttattgtggttacgagggtaacagttagacttacggtgggaccacggaccgttgtcccaccgtctccgacacgtccttcccgaaccg

SEQ ID NO: 354601 - DNA, 757 bp, Homo sapiens
  misc_feature: GZ8MTXP01DNQ36.21.35.D02.1.454.CMB.2.raw
  modified_base (250)..(250): a, c, t, g, unknown or other
  misc_feature (250)..(250): n is a, c, g, or t
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgtactttgccatgcacgtgggtccnccagactccgaggcaaggggctagngtggctggcagttancgctattcgataggaagcgtaatagtgtactagtcgcggtactccggtaggaacgggccgtacttaccaactacttcctacccgaaagtaacgaacctaaacttaccccgaaaagtaaacccgtacgtcctttagggtttacctacggtaactaaaagttcgggaaacgtaccgtaaacggtaaaccgttaaaagggaaaacggtaaacggggaaaccggaaccgggtaaccgttaagggttaaacttaaacggttaaacgtttaggtacgggtaccggtacggtaaaccggttaacgtttaacgtttaaagtttacggttaggttacggtaacgggtaaccgtaaacgtttacggttaacgttaccggttacggggtaaccggtaaccgggaaacccggttcggttaccgtaacccgtaccgttcccgtacgaccgttacccgtaaccccgaacccgtaacccggg

SEQ ID NO: 354602 - DNA, 589 bp, Homo sapiens
  misc_feature: GZ8MTXP01DN65O.21.35.D02.1.454.CMB.2.raw
  modified_base (294)..(294): a, c, t, g, unknown or other
  misc_feature (294)..(294): n is a, c, g, or t
  modified_base (568)..(568): a, c, t, g, unknown or other
  misc_feature (568)..(568): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggagcgtgttccagcctgggacgtcctgagagtctcctgtgcagcctctggattcagtcttcagtgtactttgccatgcacgtgggtccacagactcgaggcgaaggggctagagtggctggctagttatcgntattcgagtggaagcgtaatatgtactagtggcggacgttcgggtaggaacggggcctaattccactatcctaccaaagaacgaactaacttaccaaagaaacctacggtcttgttcctagaacaaatggagacaagtacgtaagaaagaagaacggacaacggtactagtaataattaacgtgtacgcgacgtagtaactttattatagtgtacgaggtaactattcgtacttacggcggtacgacggttaccttacggtcctaccgtctccncacgtcccttaaccgaacccg

SEQ ID NO: 354603 - DNA, 746 bp, Homo sapiens
  misc_feature: GZ8MTXP01EX5ZQ.21.35.D02.1.454.CMB.2.raw
  modified_base (253)..(253): a, c, t, g, unknown or other
  misc_feature (253)..(253): n is a, c, g, or t
  modified_base (301)..(301): a, c, t, g, unknown or other
  misc_feature (301)..(301): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagtcttcagtgtactttgccatcgcacgtcgggtccncagacctccgagggcgaaggggctaggaggtggcgtggctaggttacncgatagttcgagtggaagtctaattagtagtactagtcggaccggtactccggtaggaaacgggtcctaacttaccgactatccctacccgaaaagaacgtaacctaaacttacccgaaaacgtaaccgtacgttacgtttacgttttaccgacgtaaccgtaaagtacggaacgaccgaacggtaaccgtaaaagggaaaacgggaacggaacgggaaccgtaacggtacgttaacgttaaaggttaaacgttaaacggtggtacggacggtaaccggtaaggttaacctttaagtttacgttaaggttacgggtaacgtaacgggggtaaccttaaggtttaccggaacgtttacgggacggggtaacccgttaacgggttccccgttcggtaacccgtaccgttcctcccgtaccgaacgtccccgttaacccgaacccggg

SEQ ID NO: 354604 - DNA, 672 bp, Homo sapiens
  misc_feature: GZ8MTXP01CRQIV.21.35.D02.1.454.CMB.2.raw
  modified_base (304)..(304): a, c, t, g, unknown or other
  misc_feature (304)..(304): n is a, c, g, or t
  modified_base (349)..(349): a, c, t, g, unknown or other
  misc_feature (349)..(349): n is a, c, g, or t
  modified_base (352)..(352): a, c, t, g, unknown or other
  misc_feature (352)..(352): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggaggtcggggggagcgtgttccagcctgggaccgtcctgagagtctcctgtgcagcctctggattcagcttcagtgtacttgccatgctacgtcgggtcccnccagcctccgaggcgaagggggctaggagtggcgtggctagttancgntagtccgagtgggaagcgataagtgtaactagtcggcggtactccggtagggaacgggccgtacttacaccgtatcctaccaagaacgtaactaaacttaccgaaacgtaacctacgtctttacgtttacgagtaacgtaaaagtcggaacgtaccgaacggaaccgtaaagggaaaaggtaaacgggaacgggaaccgtaacggggtaacttaacgttaaagttaacgttaaacgtcgggtacggaccggttacggttaacggttaacctttaagtttaacgttagtttcgggttacgtaacggggttaaccttaaggg

SEQ ID NO: 354605 - DNA, 653 bp, Homo sapiens
  misc_feature: GZ8MTXP01D3QZ5.21.35.D02.1.454.CMB.2.raw
  modified_base (248)..(248): a, c, t, g, unknown or other
  misc_feature (248)..(248): n is a, c, g, or t
  modified_base (291)..(291): a, c, t, g, unknown or other
  misc_feature (291)..(291): n is a, c, g, or t
  modified_base (305)..(305): a, c, t, g, unknown or other
  misc_feature (305)..(305): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtgggtccncagactccaggcaaggggctagagtggctggctagttatccgntagttcgatggaancgaattatgtaactagtggcggtactccggtaggaaaggggccctattccgaacctagtccctcccgaaagtacgaacctaaatttccccgaaaaggtaacctacggtcttaggtttactgactaaatggaacgcaaggtacctaggaaaagaaggacggaaccgaggtacttaggttaattaacgtaaacgtgtacgacgacgtaaggttaacctttaatttacgttagttagggttacgaaggggtaacctagttacggaacgttacggtcgggggaccttaacggggttaacccttcgggtccctaccggttcctacccgtcgaccgtcccgttcccgaacccgg

SEQ ID NO: 354606 - DNA, 731 bp, Homo sapiens
  misc_feature: GZ8MTXP01BKSMV.21.35.D02.1.454.CMB.2.raw
  modified_base (251)..(251): a, c, t, g, unknown or other
  misc_feature (251)..(251): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgtactttgccatgcacgtcgggtccnccacgacctccgaggcgaaggggctagagtggcgtggcagttancgntattcggatggaagcgtaattatggtaactgtcggccggtactccggtaggaacggggccgtaactttacccgaactactccgtacccgaaagaacgtaacctaaacgtttaacccgaaacgtaacccgtaaccggtctttaggttttaccacggtaaactaaagttcgaacgacgaagtacccgtaaaggaaaacggaaggaacgggaacgacgggtacttaggttaaactaacgttaaacggtggtacggaccggtaacggaacggtttaacctttaaagtttaagttacggttacgggtttacgaaacggggtaacctaagtttacgggaccgttaacggggtcggggaacccgttaacggggacccgttcgggtaacccttaccgggtaacccttccgaccgacccgtccccgttaaccgaaccccggg

SEQ ID NO: 354607 - DNA, 555 bp, Homo sapiens
  misc_feature: GZ8MTXP01C4WJS.21.35.D02.1.454.CMB.2.raw
  modified_base (250)..(250): a, c, t, g, unknown or other
  misc_feature (250)..(250): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
  modified_base (387)..(387): a, c, t, g, unknown or other
  misc_feature (387)..(387): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccactggtggagtcggggggagcgtgttccagcctgggacgtccctgagagtctcctgtgcagcctctggattcagtcttcagtgactttgccatgcacgtgggtccncagactcgaggcgaaggggctagagtggctggctagttancgnattcgatggaagcgtatatgtactagtggcggactcgagacggcctatcacntccacaaganaacatccaagacngtcttgttcngacaatgancagacgtaagaaagagagacacggatagtaatagtacgtgcgacgtcgaagttactttattattgttggtaacgagggtaactagttacgtacgttacgggtcggggaccaacgggttcccttcgggtcccaccgtcctacccgtgaccgtcccgttcccgaacccgg

SEQ ID NO: 354608 - DNA, 590 bp, Homo sapiens
  misc_feature: GZ8MTXP01AUZZ6.21.35.D02.1.454.CMB.2.raw
  modified_base (247)..(247): a, c, t, g, unknown or other
  misc_feature (247)..(247): n is a, c, g, or t
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (399)..(399): a, c, t, g, unknown or other
  misc_feature (399)..(399): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccncagactccaggcaagggctagngtggctggcagttancgntattcgatggaagcgatatgtactagtggcggactcggtagaaacggggcctacttccacctatcctaccaaagacgaactaaatcccgaaagaaccacgtcttgttttacnacaaatgaagcagacctagaaagaagaggacacggctagtatagtaactgtcgcgcgtaaggtacctttaattattagtacgttacgaagggtaacctagttcgacgttacggtcggggaccttacggggttaccccttgggtaaccctacccggttcctcccgtacgaccgtccccgttccgaaccccgg

SEQ ID NO: 354609 - DNA, 641 bp, Homo sapiens
  misc_feature: GZ8MTXP01C6F2G.21.35.D02.1.454.CMB.2.raw
  modified_base (250)..(250): a, c, t, g, unknown or other
  misc_feature (250)..(250): n is a, c, g, or t
  modified_base (288)..(288): a, c, t, g, unknown or other
  misc_feature (288)..(288): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcacgtgggtccncagactccaggcaaggggctagagtggctggcagttancgctattcgatggaagcgatatgtactatgcggactcgtagaaggccactcacatctacaaagagaacaattacccaaagaacacgcttgtttacctagactaaagtgaagcaagacctaagaaaagaaggaacgacgacggtactagttaataataaacgtgtcggacgacggtaacggttaacctttaagtttaattaacggttacgggttacgtaaacgggggtaaccctaagtttacgggtaaaccgttacggggttacgggggaccccgttaaacgggggttacccccttacggggtaaccctacccggttcctccctccgaacgtccccgttaaccccgaacccggg

SEQ ID NO: 354610 - DNA, 663 bp, Homo sapiens
  misc_feature: GZ8MTXP01BG0RH.21.35.D02.1.454.CMB.2.raw
  modified_base (250)..(250): a, c, t, g, unknown or other
  misc_feature (250)..(250): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgccatgcacgtgggtccnccagacctcgaggcgaagggctagagtggctggctagttancgnattcgatggaagcgatatgtactatggacgtactcgtaggaacgggcctattccacctatccctaccaaagacgaactaaactaccaaagtaccacgtcttgtttacagacaatgagcacgactaagaaacgagacgacgacggtactaggtaatactaacgtggtacggacgtacggtaacggttacctttaagtttaattcgttacgggttaacgaacggggtaacctaaggttttaccggaaaccggttacgggtaccgggggtaacccgttaaaccgggggttaaccccttcgggtaaccccgttaacccggtcccttccccgttaccgacccggtaaccccccttaaccggtaaacccccgggg

SEQ ID NO: 354611 - DNA, 638 bp, Homo sapiens
  misc_feature: GZ8MTXP01ASSPP.21.35.D02.1.454.CMB.2.raw
  modified_base (254)..(254): a, c, t, g, unknown or other
  misc_feature (254)..(254): n is a, c, g, or t
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgtactttgccatgctacgtcggggtcccncagactccgaggccgaagggggctagaggtcggctggctagttancgnagttcgatggaagcgtaatatcgtactagtcggaccggtactccggtagaaacggggtcctaacttccacgtatccctacaaagacgaactaaactcccgaaagacctaccgcttgtttactagacaaatgacgacagacctaaggaaagaacgaggactacggtactagtaataacgtaacgtgacgaccggtacgtaacggttaacctttaagtttaagttaggtacggttacgaacgggtaactaacgttaggacgtttaccggcgggtaccgaaccgggttcccttacggtcccacgttccctccgaccttaccgtcccgttccgaacccgg

SEQ ID NO: 354612 - DNA, 691 bp, Homo sapiens
  misc_feature: GZ8MTXP01AHMMB.21.35.D02.1.454.CMB.2.raw
  modified_base (209)..(209): a, c, t, g, unknown or other
  misc_feature (209)..(209): n is a, c, g, or t
  modified_base (302)..(302): a, c, t, g, unknown or other
  misc_feature (302)..(302): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctntggattcagtcttcagtgtactttgccatgcacgtcgggtccgccagacctccgagggacgaaagggggctaggaggtggctggactagttancgctagttcgagtggaagcgatatgtactgtcggcggtactccggtaggaacggggcctacttccaacctataccctaccgaaaagaacgtaacctaaacttacccgaaaagtaaacccgtcgtccgtttagtttaccgtagtaacctaaaagtggaacgacgtaacggacccgtaaagggaaaacggaaacgggaacgggaaccgacgggtacttaggtaattaacgtaaacgtggtacggccggtagtaaccggttactttaagtttaagttagtcggttaacgacgggtaacctagttacgacgttacggtcggggaccaacggggttacccttcgggtaaccctacccgttaacctcccacgacctccccgttaacccgaaccgg

SEQ ID NO: 354613 - DNA, 732 bp, Homo sapiens
  misc_feature: GZ8MTXP01BZENQ.21.35.D02.1.454.CMB.2.raw
  modified_base (253)..(253): a, c, t, g, unknown or other
  misc_feature (253)..(253): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcggggggaggcgtgttccagcctgggacgtccctgagagtctcctgtgcagcctctggattcagcttcagtgtactttgccatgcacgtcgggtccnccagacctccgaggcgaagggggctaaggagtggctggctagttanccgntagttcgagtaggaagcgtaattagtgtaactagtcggacggtaccttccggtaggaacggggtccctaattcccaacctattccctaccgaaaaggaacgtaacctaaacttacccgaaaagtaaccctacgtcgtttcgtttacagtacaaaagtgaacgacgaagtacccgtaaggaaaaacggaaggaacggaacgaacgggtattaacggttaaattaaagttaacgtggtacggaccggtaacggtaacggttaacctttaagtttaacgtttaaggttcgggtttaacgaacgggtaaccttaagttacggtaacgttaaccgggtcgggggtaacccgttaacggggttaacccgttacgggtcccctacccggtccttccccgtaccggttacccgtccccgttaacccgaaaccccggg

SEQ ID NO: 354614 - DNA, 645 bp, Homo sapiens
  misc_feature: GZ8MTXP01ANR1Y.21.35.D02.1.454.CMB.2.raw
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
  modified_base (608)..(608): a, c, t, g, unknown or other
  misc_feature (608)..(608): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggaggtcggggggaggcgtgttccagcctgggacgtccctgagagtctcctgtgcagcctctggtattcagcttcagtgtactttgccatgcacgtgggtccncagactcgaggcgaaggggctaggagtggctggcagttancgctattcgagtggaagcgatatgtactagtcggcggtactccggtaggacgggccgtacttaccactatcctaccaaagacgtaacctaaattaacccgaaagtaaccacgtcgtttacgtttcctaggactaaaatggaacgacgaacgaccgtaaaggaaaacggaaaggaacgggaaccgaacgggtacgttagtaattaacgttaaacgtggtacgacggacgtaaggtaacctttattagttagtggttacgacggtaactagttgacgttacggcggggtaacgacgggttacccttcgggtaaccnccgtcctcccgcgaccgtccccttaacccgaacccgg

SEQ ID NO: 354615 - DNA, 646 bp, Homo sapiens
  misc_feature: GZ8MTXP01CQ612.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgccatgctacgtcgggtccgccagacctccgaggacgaaggggctaggagtggctggactagttatcgctagttcgatggaagcgtaatatgtactagtggcggtactccgtaggaacgggtccgtaacttccactatcctaccaaagacgaactataacccaaagacacgcttcgttactagactaaagtgagacagacgtagaaagaaggagacgacggtactagttaagtaataaacgtggtagaccgtacggtaacggttacctttaagttaagtttaagtcgggttacgaacgggtaacctaggtttcgaaaccgttacgggtacggggtacccgacggggttaacccttcggggtaaccctaccccgttcgtccctcgttaccctaacccgttaacccgtaacccggg

SEQ ID NO: 354616 - DNA, 571 bp, Homo sapiens
  misc_feature: GZ8MTXP01DHFE6.21.35.D02.1.454.CMB.2.raw
  modified_base (338)..(338): a, c, t, g, unknown or other
  misc_feature (338)..(338): n is a, c, g, or t
  modified_base (348)..(348): a, c, t, g, unknown or other
  misc_feature (348)..(348): n is a, c, g, or t
  modified_base (375)..(375): a, c, t, g, unknown or other
  misc_feature (375)..(375): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcacgtgggtccgccagactccaggcaaggggctagagtggctggcagttatcgcattcgatggaagcgatatgtactatgcggactcgtgaggccatcacntctacaaganaacaatccaaagaacacgctgtttccngacaaatgagcagactagaaagaagacggacacggactagtaatataacgtgtagacgcgtaacggtactttaatttagttaagttgggttaaacggtctaagttgacgtacgttggggtaccgacgggttaacccgttcgggttacctaaccggttcctccgtccacgttcccgtaacccgaacccgtaaccggg

SEQ ID NO: 354617 - DNA, 655 bp, Homo sapiens
  misc_feature: GZ8MTXP01DI4L8.21.35.D02.1.454.CMB.2.raw
  modified_base (252)..(252): a, c, t, g, unknown or other
  misc_feature (252)..(252): n is a, c, g, or t
  modified_base (357)..(357): a, c, t, g, unknown or other
  misc_feature (357)..(357): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagtcttcagtgtactttgccatgcacgtggggtccncacgactccgaggcgaaggggctaggagtggctggctagttatcgacattcgagtggaagcgtaatatgtactagtggcgtacgtcgtaggacggcctactcacntcctccgaagacgaactaaactacccgaaagaccacgtcttagtttctagactaaagtgacgtacaacgacgtaaggaaaagaacggaacggaacgacggtacttagttaaacttaaacgtaacgttggtacggaccggtaacggtaacggttaacctttaaagtttaacgttagttcgggttaaccgaaggggtaacctagttacggtaaacgttacgggtcggggaacccgttaacggggttacccttcgggtaacctacccggtctcccgtcgaccgtcccttaaccgaacccgg

SEQ ID NO: 354618 - DNA, 604 bp, Homo sapiens
  misc_feature: GZ8MTXP01AU71Y.21.35.D02.1.454.CMB.2.raw
  modified_base (249)..(249): a, c, t, g, unknown or other
  misc_feature (249)..(249): n is a, c, g, or t
  modified_base (292)..(292): a, c, t, g, unknown or other
  misc_feature (292)..(292): n is a, c, g, or t
  modified_base (459)..(459): a, c, t, g, unknown or other
  misc_feature (459)..(459): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtgggtccnccagacctccgaggcgaaggggctaggagtggctggcagttancgctattcgagtggaagcgtatatagtactagtggacggactcggtaggaacgggcctacgttccaactagtctaccgaaagacgaactaaactacccaaagaacctcgtacttgtttaccagacaaagtgagactagaccgtaagaaaggagaacggacaacggtntaagtaactaataacgttgacgcgacgacggtaactttattaacgttgtacggttcgaacggtaactaagttcgacgttacgcggggacgacgggttacccttgggaacctccgtctcctacgacctcccgttaaccgaacccgg

SEQ ID NO: 354619 - DNA, 645 bp, Homo sapiens
  misc_feature: GZ8MTXP01AWM0G.21.35.D02.1.454.CMB.2.raw
  modified_base (222)..(222): a, c, t, g, unknown or other
  misc_feature (222)..(222): n is a, c, g, or t
  modified_base (251)..(251): a, c, t, g, unknown or other
  misc_feature (251)..(251): n is a, c, g, or t
  modified_base (293)..(293): a, c, t, g, unknown or other
  misc_feature (293)..(293): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttnagtgtactttgccatgctacgtgggtccncagacctcgaggcgaaggggctaggagtggctggctagttancggctagttcgagtggaagcgaatagtgtaactagtcggaccggtactccggtaggaacgggtcctaacttccgactagtcctaccgaaagaacgaactaaactacccaaagtaaccacgtctagtttcagtaacaaagtcgacgaccaagaccgtaaggaaagacggaaggaccgacggtattaagtaagtaactaacgtggacgaccggtacgtaacggtactttaaattagttcgttaggttaccgaagggtaaccttagttacggacgttacgggtacggggacccttaacggggttacccttggtaaccctaccgttccaccgtcaccgtccttaacccgaaccggg

SEQ ID NO: 354620 - DNA, 747 bp, Homo sapiens
  misc_feature: GZ8MTXP01BWD9W.21.35.D02.1.454.CMB.2.raw
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccaccgtgggtggaggtcggggggagcgtgttccagccgtgggacgtcctgagtagtctcctgtcgcacgtcctcgtggacttcagtcttcgagtgtacttgccatcgctacgtcgggtcccgaccagacctccgaggacgaacgggggtctaggaggtggctggactagttatcgctagttccgatgggaagcgtattaagtcgttaactagtcggaccgggtaccgtacggtagggaacggggtaccctacgttaccaaccgtactccgtaccgaaggtaaacgtaaccaaacgtttaaccccgaaaagaaccgtaccggttacgtttaccggttttacacgtaaccgtaaaaggttacggaacgacccgtaacggtacccgtaaaagggaaaacggtaaacggggaaacggaacccgtaaccgggtaagttaaggttaaacttaaacggttaaaccggtgggtaaccggttcgggttaacgggttaacggtttaaccgtttagtttaacgtttacggtacggggttacgtaacggggttaactttaaccggg

SEQ ID NO: 354621 - DNA, 704 bp, Homo sapiens
  misc_feature: GZ8MTXP01E3LIY.21.35.D02.1.454.CMB.2.raw
  modified_base (252)..(252): a, c, t, g, unknown or other
  misc_feature (252)..(252): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctctgtgcagcctctggattcagtcttcagtgtactttgccatgcacgtcgggtccnccagacctccgaggcgaaggggctaggagtcggcgtggactagttactcgctagttcgagtaggaagcgaattagtcgtacgtagtcggaccggtaccgttaccggagggaaacggggccctaacttaccgactactccctaccgaaaggaacgtaacctaaacgtacccgaaaacgtaaccgtacggtccttagtttacacgtaactaaagtcggaacgacgaacgtaacccgtaaagggaaaacggaacggaaggaccgaacggtataagttaacgtaacgttaacgtggacggtaccggtaccgtaacggtttaacctttaagtttagtttaggtacggtacgagggtaacctagttacggacgttacggacggggaaccgttaccgggttaccttcgggtaaccctcccggttcctccgtaccgccggtaacccttcccgaacccggg

SEQ ID NO: 354622 - DNA, 736 bp, Homo sapiens
  misc_feature: GZ8MTXP01DHTQD.21.35.D02.1.454.CMB.2.raw
  modified_base (255)..(255): a, c, t, g, unknown or other
  misc_feature (255)..(255): n is a, c, g, or t
  modified_base (293)..(293): a, c, t, g, unknown or other
  misc_feature (293)..(293): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctcgtggattcagtcttcgagttgtactttgccatgctacgtcgggtccncagctccgaggcgaagggctagagtgctggctaggtancgactagttcgagttggaagcgaattagtagttactagtgaccggtactccggtaggaacggggtcctacttaccacctagtccacccgaaaagaactaacctaaacttaaccgaaacggtaaaccacgtcgttacgttttacgagtaacctaaaaggtacgaacgtaacgaacgtaacgtaaaaggaaagaaacggaacggtaaccgaaggtacgtaagttaacgtaaggtaacgtggtacggtacggtaacgttaaacgttaacgtttaaagttacgttaaggttaccggtaacggaaacggttaacgttaacggttaccggtaaacggttaccggggtaccggggtaacccggttaaaccgggttcccgttaccgggttaaccctccccgttaaccgtacccgtaccgttacccgtaaccccgttaacccggtaacccgg

SEQ ID NO: 354623 - DNA, 565 bp, Homo sapiens
  misc_feature: GZ8MTXP01EMMU8.21.35.D02.1.454.CMB.2.raw
  modified_base (253)..(253): a, c, t, g, unknown or other
  misc_feature (253)..(253): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (354)..(354): a, c, t, g, unknown or other
  misc_feature (354)..(354): n is a, c, g, or t
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (421)..(421): a, c, t, g, unknown or other
  misc_feature (421)..(421): n is a, c, g, or t
  modified_base (437)..(437): a, c, t, g, unknown or other
  misc_feature (437)..(437): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagccttcgtggattcagctttcagtgactttgccatgcacgtgggtccnccagactcgaggcgaagggctagagtggctggcagttancgntattcgatggaagcgntatgtacatggcgactcgagcggactcttcacatccacaaganaactaatccaagaccngtctnttcatacaaatgagcagaccgtagaaagaggtaacgacgaacggtntagtagtagtaagtgngacgacgtacgttaacttattagtagtcggtacgaacggtaactagttacggacgttacggacgggtaccgaacgggttccttcggtaacctccgtaaccgtcacgccgtaacccgttaaccgaaccg

SEQ ID NO: 354624 - DNA, 743 bp, Homo sapiens
  misc_feature: GZ8MTXP01AODRS.21.35.D02.1.454.CMB.2.raw
  modified_base (250)..(250): a, c, t, g, unknown or other
  misc_feature (250)..(250): n is a, c, g, or t
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
  modified_base (304)..(304): a, c, t, g, unknown or other
  misc_feature (304)..(304): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtcgggtccncagactcgaggcgaagggctagngtggctggctagtancgntattcgatggaancgtaatagtcgtactagtcggaccggtacttccggtaggaaacgggtcctaacttccaacctatcctaccgaaagaacgaactaaacgttacccgaaaagaacctacgtctttacggtttacacgaactaaagtcgaacgacgaacggtaacccgtaaagggaaaaacggaaacggaacgggtaaaccgaaccggggtattaaggttaaacgttaaacgttaaaccggtggtaccgggaaccggtaacggttaaacggtttaaccttttaaagtttaacgtttaacggttacgggttaaccgaacggggtaaccttaaggtttaccgtaaaccggttacgggtacgggggaacccgttaaacggggttaaccccgttcgggtaacccctacccgttcctacccgtaccgacccggtaaccccttaacccggaaacccgg

SEQ ID NO: 354625 - DNA, 629 bp, Homo sapiens
  misc_feature: GZ8MTXP01AKJ6G.21.35.D02.1.454.CMB.2.raw
  modified_base (254)..(254): a, c, t, g, unknown or other
  misc_feature (254)..(254): n is a, c, g, or t
  modified_base (299)..(299): a, c, t, g, unknown or other
  misc_feature (299)..(299): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgcctatcgcacgtcggggtcccnccagacctccgaggcgaaggggctaggagtggcgtggctagttancgctagttcgagtggaagcgaatatgtactagtggacggtactccggtaggaacgggtccgtacttccactagtccacgaaagaacaactaactaccgaaagaccctacgtcttagttcacgaactaaagtcgacacgaacgtaccgtaaagaaaaggaggacgacgacggtacttaacgtaataacgtacgttgacgtcgacggtacgttaactttagttagtagtcggttacgaggtaactagttcggacttacgggcgggtaccgacgggttacccttcgggtaacctcccggttcctcgaccgactccccgttaaccgaacccggg

SEQ ID NO: 354626 - DNA, 561 bp, Homo sapiens
  misc_feature: GZ8MTXP01EYUV4.21.35.D02.1.454.CMB.2.raw
  modified_base (247)..(247): a, c, t, g, unknown or other
  misc_feature (247)..(247): n is a, c, g, or t
  modified_base (284)..(284): a, c, t, g, unknown or other
  misc_feature (284)..(284): n is a, c, g, or t
  modified_base (349)..(349): a, c, t, g, unknown or other
  misc_feature (349)..(349): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtcctgagagtctcctgtgcagcctctggattcagcttcagtgactttgccatgcacgtgggtccncagactccaggcaaggggctagagtgctggcagttancgcattcgatggaagcgtaatatgtactatggcgactcgagaacggctactcacatctccaaganaactaaatccaaanacacgtnttgttctgacaaatgancanacagaaagagagacacgtatagtaagtaataacgtgtacgacgacgtagtactttaattattagtgttacgaagggtaacctaagttagacgttacggtcggggaccgaaacgggttacccgttcggtaaccctacgttcctccgtacacgtccccttaacccgaacccgg

SEQ ID NO: 354627 - DNA, 600 bp, Homo sapiens
  misc_feature: GZ8MTXP01DK2Z3.21.35.D02.1.454.CMB.2.raw
  modified_base (228)..(228): a, c, t, g, unknown or other
  misc_feature (228)..(228): n is a, c, g, or t
  modified_base (251)..(251): a, c, t, g, unknown or other
  misc_feature (251)..(251): n is a, c, g, or t
  modified_base (294)..(294): a, c, t, g, unknown or other
  misc_feature (294)..(294): n is a, c, g, or t
  modified_base (328)..(328): a, c, t, g, unknown or other
  misc_feature (328)..(328): n is a, c, g, or t
  modified_base (406)..(406): a, c, t, g, unknown or other
  misc_feature (406)..(406): n is a, c, g, or t
  modified_base (441)..(441): a, c, t, g, unknown or other
  misc_feature (441)..(441): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagtcttcagtnactttgccatgcacgtgggtccncagactccgaggcgaaggggctaggagtggctggctagttacncgctattcgagtggaagcgtaatagtgtactagngcgactcggtagacggctactccacatcacaagacaactaactaccaaagaaccacgtcttgtttacagacaaatganacgacgacgtaagaaagaaggaacggacaacggtnttagtaataacgttaaacgtgtacggacgtacgtaagtaccttttaattagttgttacggtacagggtaacctagttacgtacgttacggtcgggaccgttaacgggcccttcggtaaccgacccgttcctaccctcgactccccgttaacccgaaccg

SEQ ID NO: 354628 - DNA, 572 bp, Homo sapiens
  misc_feature: GZ8MTXP01EPUXR.21.35.D02.1.454.CMB.2.raw
  modified_base (250)..(250): a, c, t, g, unknown or other
  misc_feature (250)..(250): n is a, c, g, or t
  modified_base (291)..(291): a, c, t, g, unknown or other
  misc_feature (291)..(291): n is a, c, g, or t
  modified_base (329)..(329): a, c, t, g, unknown or other
  misc_feature (329)..(329): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcacgtgggtccnccagactccgaggcgaaggggctagagtggctggcagttancgctattcgatggaagcgatatgtactatgcgactcgngaaggcatcacatctcaagacaactaaatacccaaagaaccacgtcttagtttactagacaaatgagacagaccgtagaaagagaggacacggatagtaatataacgtgtacgacgcgaagtacttaattagttagtggttacagggtaactagttacgacgttacggtcggggaaccacggggttaacccttgggtaaccctaccgttccttcctacgttaccaacccttcccgaaacccgg

SEQ ID NO: 354629 - DNA, 711 bp, Homo sapiens
  misc_feature: GZ8MTXP01BILRP.21.35.D02.1.454.CMB.2.raw
  modified_base (254)..(254): a, c, t, g, unknown or other
  misc_feature (254)..(254): n is a, c, g, or t
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
  modified_base (316)..(316): a, c, t, g, unknown or other
  misc_feature (316)..(316): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagtcttcagtgtactttgccatgcacgtcgggtccnccagactccgaggcgaaggggctaggaggtggcgtggctagttancgntattcgagtggaancgtatagtgtactagtcggacggtacgttccggaggacgggcctacttccgacctatccctacccgaaagaacgtaacctaaacttacccgaaagtaacctaccgttcttacgttttactagaactaaaagtcggaacgacgaacggaccgtaaagggaaaacggaacgggaaacggacgtaacgggtattaagtaacttaacgtaacgtggtacggcggtaacggtaacggtttaactttagtttaagttacggttcggttaaccgaagggtaaccttaagttacggaaccgtttcggggaccggggtacccgggttaaccggggttacccttcgggtaacccgtacccgttcccgtccgtaccgaccggtccccgttaacccggaaccccggg

SEQ ID NO: 354630 - DNA, 744 bp, Homo sapiens
  misc_feature: GZ8MTXP01CZYEB.21.35.D02.1.454.CMB.2.raw
  modified_base (249)..(249): a, c, t, g, unknown or other
  misc_feature (249)..(249): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgccatgcacgtggtccnccagactccgaggcaaggggctagagtggctggactagttatcgctagtttcgagtcggaagcgaattagtgtactagtggcggtactccggtagaacgggcctattccacctatcctaccaaagaacgaactaacttacccgaaaaggaacctacggtactttggtttacctagaacctaaaagtggaacgaccgaaacggtaccgttaaagggaaaaagaacgggaacgggtaaacccgacggggttaacctttaggttaaattaaacgttaaaaccggtttggtaacgggacccggtaaaccgggttaaacgggtttaacccctttttaaaggtttaagttttaacgggttacgggtttaacgaacgggggtaaaccctaggtttacgtaaccgttacgggttacggggaccgttaaacgggggttaaccccttggggttaacccaacccggttcttacccgacgacccgtccccttaacccgaaaccccgg

SEQ ID NO: 354631 - DNA, 648 bp, Homo sapiens
  misc_feature: GZ8MTXP01B3IN5.21.35.D02.1.454.CMB.2.raw
  modified_base (310)..(310): a, c, t, g, unknown or other
  misc_feature (310)..(310): n is a, c, g, or t
  modified_base (408)..(408): a, c, t, g, unknown or other
  misc_feature (408)..(408): n is a, c, g, or t
  modified_base (433)..(433): a, c, t, g, unknown or other
  misc_feature (433)..(433): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccactggtggaggtcgggggagcgtgttccagcctgggacgtccctgagagtctctgtgcagcctctggattcagtcttcagtgtactttgcctatgctacgtcgggtccgccagactcgaggcgaaggggctaggagtggctggactaggttatcgcattcgatggaangaattatgtactagtcggacggtactcgtaggaacggtccgtaattccaactatcctaccgaaaggtaacaactaaacttacccgaaaagtaaacccncgtacttgtttaccagaactaaagngaacgacaacgacgtaagaaagaacggaacgaacgacggtaattagtaagttaacgtacgtggtacgacggtaacgtaaggtttacctttaagtttattaaggtcggtaacgaacgggtaacttaagttacggtaacgttacgggtacgggaaccgttaacgggttcccttcgggtaaccctaccgtcctaccgcgacgtccccaaccgaaccgg

SEQ ID NO: 354632 - DNA, 698 bp, Homo sapiens
  misc_feature: GZ8MTXP01BEM1D.21.35.D02.1.454.CMB.2.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (667)..(667): a, c, t, g, unknown or other
  misc_feature (667)..(667): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagacctcaggcgaaggggctagagtggctggcagtancgntattcgatggaagcgatagtgtactatcggcggtactccggtagaacgggccgtacttaccacctatcccgtaccgaaaagacgaactaaacgttacccaaaaggaacctaccgtctttacggttttaccacgaactaaaagtcggaacgtaccaacgggtaacccgtaaggaaaaacggtaaagggaaccggaaccgtaaccgggtacttaggttaaataacgttaaaccggtggttacggaccggtacccggtaaaggttaaccttttaaagtttacgttaaggttacgggttacgaaacggggttaacctaagttacggaccgttaggggacgggacccgttaacggggcccttagggtccccgacgtttcccnccgtacgaccgtccccgttaaccgaacccgg

SEQ ID NO: 354633 - DNA, 623 bp, Homo sapiens
  misc_feature: GZ8MTXP01BM64S.21.35.D02.1.454.CMB.2.raw
  modified_base (250)..(250): a, c, t, g, unknown or other
  misc_feature (250)..(250): n is a, c, g, or t
  modified_base (293)..(293): a, c, t, g, unknown or other
  misc_feature (293)..(293): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgttggttccncagactccgaggcgaaggggctaggagtggctggctagttacncgctagtttcgagtggaagcgtaattatgtaactagtggacgacttccggtaggaacgggccgtaacttccgactatcctacccaaagtaacgaactaaacttacccaaagaaccacgtcttagtttactagactaaatcggaacgcaacgacctaaggaaagaagaggacgacgatagtaataacgtaacgtgtcgacgcgtaacgtactttaattattagtggttacgagggtaacctagttacgtaacgttacggtacgggaccgaacggggttaccttcggtaaccgtacccgtcttacccgacacgtaaccccttccgaacccgg

SEQ ID NO: 354634 - DNA, 639 bp, Homo sapiens
  misc_feature: GZ8MTXP01DG2WT.21.35.D02.1.454.CMB.2.raw
  modified_base (253)..(253): a, c, t, g, unknown or other
  misc_feature (253)..(253): n is a, c, g, or t
  modified_base (299)..(299): a, c, t, g, unknown or other
  misc_feature (299)..(299): n is a, c, g, or t
  modified_base (410)..(410): a, c, t, g, unknown or other
  misc_feature (410)..(410): n is a, c, g, or t
  modified_base (430)..(430): a, c, t, g, unknown or other
  misc_feature (430)..(430): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagtcttcagtgtactttgccatgcacgtcgggtccnccagacctccgaggcgaaggggctaggagtggctggactagttacncgctatttacgagtggaaagcgtaattagtgtactagtcggacggtactcggtaggacggtcctacttccactatcctacaaagacaactaaatacccaaagaacaccgtnttagttacagactaaatgancagactaaggaaagacggaacgacacggtattagtaaattacgtaacgtgtacgacgtagtaacgttactttaagttagttagtacggttacgaagggttaacctagttacggtaccgttacgggttacggggaccgttaaccggggttcccttacgggtaaccctaccgttcccgttacgccgaacgtccccgttaaccgaacccggg

SEQ ID NO: 354635 - DNA, 609 bp, Homo sapiens
  misc_feature: GZ8MTXP01D1EYO.21.35.D02.1.454.CMB.2.raw
  modified_base (295)..(295): a, c, t, g, unknown or other
  misc_feature (295)..(295): n is a, c, g, or t
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
  modified_base (464)..(464): a, c, t, g, unknown or other
  misc_feature (464)..(464): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggaggtcgggggagcgtgttccagcctgggacgtccctgagagtctcctgtgcagcctctggattcagtcttcagtgtactttgcctatgcacgtcgggtcccgcagacctccgaggcgaaggggctagagtggctggctagtncgctagtcgatggancgtatatgtactagngacggactcgtagacggcctatccacatctccaaagacaactaataccaaagacctacgtcttacttacagaactaatgactcaacgtacgtaaggaaagaacggacgaacgtacgactagtaactaataacgtggacncggagtacgttaacttagtttagtgtcgtacgacggtaacctgttacggtacgttacgggtcggggtaacccgttaacgggttacccttcggtaacccctacccggttctaccccgcgacccgtccccgttaaccgaaccccggg

SEQ ID NO: 354636 - DNA, 593 bp, Homo sapiens
  misc_feature: GZ8MTXP01A8G0R.21.35.D02.1.454.CMB.2.raw
  modified_base (249)..(249): a, c, t, g, unknown or other
  misc_feature (249)..(249): n is a, c, g, or t
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
  modified_base (432)..(432): a, c, t, g, unknown or other
  misc_feature (432)..(432): n is a, c, g, or t
tcagtcgtcgctcgcacgaccggtgctcgatttagcacacgatagttgggtttggggggaagaggaagactgacggtcctgccacaggtggtgctgggcacgggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagactccgaggcgaaggggctagngtggctggcagttancgcattcgatggaancgatatgtactatgcggatccgagaggccattcacatcacaaagagaacaaatacccaaagaaaccacgtcttgtttactagacaaaagtgacgacaagtccgtaagaaagaagaagggacaacggntaagtagtaataactgacgcgtacgacggtacctttaattattagtacggttcgaaggggtaacctaagtttcgaacttacggtacggggaccgttaacgggttacccgttagggtaaccctaccggtcctccctacacggccccttaaccgaaaccccgg

SEQ ID NO: 354637 - DNA, 693 bp, Homo sapiens
  misc_feature: GZ8MTXP01DEU43.21.35.D02.1.454.CMB.2.raw
  modified_base (250)..(250): a, c, t, g, unknown or other
  misc_feature (250)..(250): n is a, c, g, or t
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcacgtgggtccnccagactccgaggcgaagggctagagtggctggcagttancganattcgatggaagcgatatgtactagtcggacggactccggtaggaacggggtccctattccaactagtcctacccgaaagaactaacaaacttacccgaaaagtaaactaccggtcttagtttacagaacaaaatcggaacactaagtaccgtaaaggaaaagaaacgggaacggaaccgaacgggtacttaaggtaaacgttaacttaaaccggtggtacgaccggtaacggtaacggttaacctttaaagtttaacgttaagttacggttaaccgaaggggtaaccctaagttacggtaacgttaccgggtagggggacccgttaaacggggaacccttcgggttaacccaaccgttcctacccgtcgaaccggtccccttaaccccgtaaaccggg

SEQ ID NO: 354638 - DNA, 763 bp, Homo sapiens
  misc_feature: GZ8MTXP01CECWI.21.35.D02.1.454.CMB.2.raw
  modified_base (252)..(252): a, c, t, g, unknown or other
  misc_feature (252)..(252): n is a, c, g, or t
  modified_base (296)..(296): a, c, t, g, unknown or other
  misc_feature (296)..(296): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgcctatgcacgtcgggtccnccacgactccgaggcgaaggggctaggagtggctggctagttancgatgttcgagtaggaagtcgtaattagtcgtactagttcggaccggtactcggtaggaacggtccgtaacttaccacctatccgtaccaaaggaacgtaactaaacgttaacccgaaacgggtaaacctacggtactttacggtttaccttacgaaactaaacgtggacgacgtaacggtaaccgttaaaggaaaacggaacggaacgggaacgtaaccgggtactttaaggtaaattaacgttaacggttcggtacggaccggttaacggtaacgggtttaaccttttaaaggtttaccgttaagtttacgggttaccgaacggggttaaaccctgttacggtaaccggttacgggttaccgggggaacccgttaacggggttaaaccccgttcgggttaacccctacccggtttcccgtcccgttaccgacccggtaaccccgttaaccccggtaaaccccggg

SEQ ID NO: 354639 - DNA, 672 bp, Homo sapiens
  misc_feature: GZ8MTXP01DT4PX.21.35.D02.1.454.CMB.2.raw
  modified_base (251)..(251): a, c, t, g, unknown or other
  misc_feature (251)..(251): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtcgggtccnccagacctccgaggacgaaggggctaggagtggcgtggactagttactcgctagttcgagtggaagcgtaattagtagtactagtggcggtacttccggtaggaaacggccgtacttaccacgtatcctaccgaaagaacgtaactaaacttaaccgaaagtaaaccacggtcttagtttacccagaactaaaagtcgaacgacgaacgtacccgtaaaggaaaagaacgggaacggaacgtacgggtacttaggttaaactaagtaaacgttgtacgacggtaacgtacggttaacctttaagttagttagtacggtacgaagggtaactagttcgaacgttacggtacgggaccgttacgggttacccttggtaaccctaccggttcacccgtcaccggtcccttaaccgaaacccggg

SEQ ID NO: 354640 - DNA, 716 bp, Homo sapiens
  misc_feature: GZ8MTXP01A30RX.21.35.D02.1.454.CMB.2.raw
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtcgggtccncagacctccgaggcgaaggggctagagtggctggctagttancgatagttcgatggaaagcgtaatagtgtactagtggcggactccggtaggaacggggcctagttccaactagtcctaccgaaagaacgtaactaaacttacccaaagaacctacggtccttagggttttaccaggtaacctaaaagtgacgaaccgagaccgtaaagggaaaagaagggaacggaaccgaacgggtacttaaggttaaataacgttaaacgttggacggtcggtaaccggtaacggttaaaccttttagtttaaatttacgggttacggtttaccggaaaggggtaacccttaaggttaccgggtaaccgtttacggggacgggggttaacccgaacgggggttaacccgttcgggtaacctacccgggttccttaccccgtcgacccggtcccttaacccgaaaccccgggg

SEQ ID NO: 354641 - DNA, 636 bp, Homo sapiens
  misc_feature: GZ8MTXP01ERCSA.21.35.D02.1.454.CMB.2.raw
  modified_base (250)..(250): a, c, t, g, unknown or other
  misc_feature (250)..(250): n is a, c, g, or t
  modified_base (370)..(370): a, c, t, g, unknown or other
  misc_feature (370)..(370): n is a, c, g, or t
  modified_base (381)..(381): a, c, t, g, unknown or other
  misc_feature (381)..(381): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtcgggtccnccagactccgaggcgaaggggctaggagtggcgtggctaagttactcgctagttcgagtaggaagcgtaattactgttaactagtcggcggtactccgggtagaacgggccgtactcacntcctacaaganaactaactaccgaaagacctacgtcttgttttcgagaacaaatggaacgacgaagtaccgtaaggaaaacgaaggaacggacacggtactagttaataagtaacgtgtacgacgtacgaaggttactttaagttagttgtacgttacgaagggtaactgtttacggaacgttacggaccggggtaaccgacgggttaaccgttccgtaacgtacccgttcgttcctacgacccgtcccttaaccccgtaacccgg

SEQ ID NO: 354642 - DNA, 704 bp, Homo sapiens
  misc_feature: GZ8MTXP01EZ057.21.35.D02.1.454.CMB.2.raw
tcagtcgtcgctcgcacgaccggtgctcgatttagcacacgatagttgggtttggggggaagaggaagactgacggtcccgccacaggtggtgctgggcacggtgggcactcgacacaacatttgcgctccactgtcaggtccacctggtggagtcgggggagcgtgttccagcctgggacgtccctgagagtctcctgtgcagcctcgtggattcagtcttcagtgtactttgccatgctacgtcgggtccgcagacctccgaggaccgaaggggtctaggaggtcgggctggactaagttacgtcgctagttacgagtcgggaagtcgaattagtagtactagtcggcggtacctacggtaggaacgggcctattacccacctatccgtacgaagaaacgaactaacgttaccaaagaactacgtctttagtttacagtaactaaagtcgaacgtacacgtaacgaaaggaaaaggaaacggaacgggtaacgaccggtacgttaagttaaagttaaacgggtaacgtttacggaacggtaccggtaaacgggtaaacgtttaacccttttaaagttaaccgttacgttaggttaccgtaacggtaacctaaggtttacgacgttacgggttccgggaacgtaccggttaacccgttggaccctccgcctaaccgctaccgacctaacccgaacgtaacccg

SEQ ID NO: 354643 - DNA, 589 bp, Homo sapiens
  misc_feature: GZ8MTXP01D5EUQ.21.35.D02.1.454.CMB.2.raw
  modified_base (249)..(249): a, c, t, g, unknown or other
  misc_feature (249)..(249): n is a, c, g, or t
  modified_base (290)..(290): a, c, t, g, unknown or other
  misc_feature (290)..(290): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccnccagacctccgaggcaaggggctagagtggctggcagttancgcattcgatggaagcgtatatgtactagtgcggactccgtgaacgggccattccactatcctcccaaagagaactaattacccaaagacacgtcttgtttcagacaaatgagcaagaccgtagaaagagagacacggactagtataatacgtgtcgcgcgagtacttaattagttagtggttacgagggtaacctagttcgacgttacggtacgggggtacccttaacggggttaccccgttggtaacccgtaacccgttcctcccgtccgaccgtccccgttaacccgaaaccccgg

SEQ ID NO: 354644 - DNA, 619 bp, Homo sapiens
  misc_feature: GZ8MTXP01CER6Y.21.35.D02.1.454.CMB.2.raw
  modified_base (253)..(253): a, c, t, g, unknown or other
  misc_feature (253)..(253): n is a, c, g, or t
  modified_base (276)..(276): a, c, t, g, unknown or other
  misc_feature (276)..(276): n is a, c, g, or t
  modified_base (290)..(290): a, c, t, g, unknown or other
  misc_feature (290)..(290): n is a, c, g, or t
  modified_base (350)..(350): a, c, t, g, unknown or other
  misc_feature (350)..(350): n is a, c, g, or t
  modified_base (407)..(407): a, c, t, g, unknown or other
  misc_feature (407)..(407): n is a, c, g, or t
tcagtcgtcgctcgcacgaccggtgctcgatttagcacacgatagttggggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgtactttgccatgcacgtcgggtccncagactcgaggcaaggggctagngtgctggcagttancggactagttcgaagtggaagcgtatagtgtatagtgcggtactcgagaggcctatcacntcacaaagtacaacaacttaccaaagtaccacgtcttagtttcagataaagtgaacncgaacgaacgtaaggaaaagaacggaacgaacgtaacggtcttaagttaagttaagtaaacgttgacggtacgacgtaaacgttacttaagttagttacgttacggtacgtaacggtaactacgttaggtaccgttacgggtacgggacccgttaacggttccgttaccgtaaccgtaccctctcccgtacgacgttccccgcgtaacccgg

SEQ ID NO: 354645 - DNA, 720 bp, Homo sapiens
  misc_feature: GZ8MTXP01CJNP2.21.35.D02.1.454.CMB.2.raw
  modified_base (254)..(254): a, c, t, g, unknown or other
  misc_feature (254)..(254): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (295)..(295): a, c, t, g, unknown or other
  misc_feature (295)..(295): n is a, c, g, or t
  modified_base (315)..(315): a, c, t, g, unknown or other
  misc_feature (315)..(315): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagtcttcagtgtactttgccatgcacgtcgggtccnccagcctccgaggcgaagggctagngtggngtggcagttancgactattcgagtggaacgngtaacttagtagttacgtacgtcggaccgggtaccgtccgggtaagggaacggggtaccgtaccttacaccgtattccgtaccgaaagtaacgtaactaaaccgtttaaccgaaacgtaaccacgttcttaggtttacctacgaactaaactcggaacgtaccgaacgtaaccggtaaagggaaaaggaaacggggaacgggaacctaccgggttacgtaagttaaacgtacgttaaacggttcgggtaacgggtacgtaaccgggtaaacgtttaacttttaagtttaccgttaggtcgttaacggacggaactttagttcgaaccgttacgggtcgggaccgaaccggttcccgttacgtcccgtctaaccgtccctacgaccgtcccttaacccgaacccgg

SEQ ID NO: 354646 - DNA, 746 bp, Homo sapiens
  misc_feature: GZ8MTXP01CFXJA.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcatgtgcagcctctggattcagtcttcagtgtactttgccatgctacgtgggtcccgccagacctccgaggccgaaaggggctaggaggtggcgtggctagttacgcgctagttcggagtagggaacgtcgtaattagtagttaaccttagtcggaccggtaccttccggtaggaaaccggggtcccccgtattaccgaaccctactcccgtaacccaagaacgtaacctaaacgttacccaaagaaccgtacgtctttacgttttaccgagtaacctaaaagttcgggaacgtaccgtaacggtacccgtaaaggaaaaacgggaacgggaacggtaaaccggaacggggttacttaagggttaaacgttaacgttaaaccgtgggttacggaccggtaacgggttacggttaaccttttaagttaagttacgttcgggtacgtaacggggtaacttacgttacggaccgtacgggtacggggaccgcggggttaaaccctcgggtaccctaaccgttccgtcccgttacgtccgttcccgtaaccccgg

SEQ ID NO: 354647 - DNA, 753 bp, Homo sapiens
  misc_feature: GZ8MTXP01DQ7CX.21.35.D02.1.454.CMB.2.raw
  modified_base (253)..(253): a, c, t, g, unknown or other
  misc_feature (253)..(253): n is a, c, g, or t
  modified_base (298)..(298): a, c, t, g, unknown or other
  misc_feature (298)..(298): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggaggtcggggggagcgtgttccagcctgggacgtccctgagagtctcctgtgcagcctctggattcagcttcagtgtactttgccatgcacgtcgggtccncagactccgaggcgaaggggctaggagtggcgttggactagttanccggatagttacgagtacggaagtcgtaatagtgtactaagtcggacggtaacttccggtaggaaacggggtccctaattacccaaacctagttacccacccgaaaagggaacgtaacctaaacgtttacccgaaaaaaaggtaaacccctaccgggttcttttacgggttttaacctacggaaactaaaacgttggaacggtaccaaacggtaaccgtaaagggaaaaaggaacgggaaacggaaccgacgggtaacttaggttaaattaaacgttaaacgttggacgacgtaccggtaaggttaacctttaaatttagttaagttgggtaccgtaaaggggtaacctaggttacgtaccggttaacggtcggggaccgaaaccggggttcccttacggggttaacctaacccggttcttaaccccgtcgacccgtcccgttaacccgaaccgg

SEQ ID NO: 354648 - DNA, 759 bp, Homo sapiens
  misc_feature: GZ8MTXP01CTJ6W.21.35.D02.1.454.CMB.2.raw
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtcgggtccnccagacctccgaggcgaaggggctagagtggctggcagttancgnattcgatggaagcgtatatgtactagtcggacggtactccggtaggaacgggtccgaacttccaaccattcctacccgaaaagaacgaaccgtaaacttacccgaaaagtaaacccaacgtcctttagtttacctacggtaacctaaaagtcggaaacgtaccgaaacgtaacccgttaaagggaaaaagggtaaacggaaacgggaaccgaaacgggtacgttaaggttaaattaaacgttaaaccgttgggttacgggaccggtaaccggtaaacggttaaccttttaaagttttaacgtttagggttacggtttaacggaacggggtaaaccctaaggtttacggaaccggttacgggtacgggggtacccgttaaaccgggggttaacccgttcgggttaaccctaccccgggttcccttacccgtaccgaccggtccccgttaaccccgtaaccccggg

SEQ ID NO: 354649 - DNA, 726 bp, Homo sapiens
  misc_feature: GZ8MTXP01CDZIS.21.35.D02.1.454.CMB.2.raw
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagtcttcagtgtactttgccatgcacgtcgggtccncagactccgaggcgaagggctagagtggctggcagttacncgctattcgagtaggaagtcgtaattagtagtactagtcggacggtaccgtccggtaggaacgggtcctaacttccgaactactacccgtacccgaaaagtaacgaacgtaaactttaacccgaaaacggtaaacccgtacggttaccgtttacgtttacctaacgggtaacctaaaagtcggaaacgtacgaaacggtacccgttaaaagggaaaaggtaaacggaaccgggtaccgaacgggtacgtaacgttaaaggttaaacttaacggtggtacggacggtaaccgtaacggttaaccttttaagttagttaggtacggttacgaaacgggtaaccttagttacggtaccgttacgggtacggggacaaccggggttccttcggtccctaccgtcctccgccggccctaacccgaacggtaacccgg

SEQ ID NO: 354650 - DNA, 749 bp, Homo sapiens
  misc_feature: GZ8MTXP01EZI54.21.35.D02.1.454.CMB.2.raw
  modified_base (260)..(260): a, c, t, g, unknown or other
  misc_feature (260)..(260): n is a, c, g, or t
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagtcttcagttgtacttttgcctatcgctacgtcggggtcccnccagactccgaggcgaagggggctaggaggtggctggctagttacncgntagttcgagtggaagcgatatgtactagtcggcggactccggtaggaacgggccgtaacttccactagtcctacccgaaagaacgtaacctaaacttacccgaaacgtaaccgtacgtcgtttagttttacacggaactaaaagtggaaacgcgaacgtaacccgtaaagggaaaaacggaaacggaacgggaaccgtaacggggtaccttaagggttaaataacgttaaaccggttggttacgggaccggtaaccggtaacgggtttaaaccttttaagttaagtttacggttacgggtaccggtaaacggggtaacccttaaaggtttccggaaacggtttaaccggggtcgggggtaacccggaccggggttaaccccgttcggtaacccgtaccgttaaccctcccgtacgaccggtcccttaaccccgaaccggg

SEQ ID NO: 354651 - DNA, 705 bp, Homo sapiens
  misc_feature: GZ8MTXP01BXA9V.21.35.D02.1.454.CMB.2.raw
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagtgtactttgcctatgctacgtcggggtccnccagactccgaggcgaagggctagngtgctggctagtancgctattcgatggaagcgaattatcgtaactagtcggcggtaccttccggtaggaacggggtcctacttccacgtactcccgtaccaaagaacgaactaaacttacccgaaaaggtaacccaccggttcttacggttttacaggtaacctaaaagtggacggtacaacggtaccgtaaagggaaaacgaaagggaaccggaacgaaccggggtacttagggttaacttaaacgtaaccggtggtacggaccgtacggtaaacggttaccttttaattacgttaggtcgtttaacgacgggtaacctagttacggaccttacgggtacgggccgttaacgggttaccccttgggttaaccctcccggttaactaccctccgttaccgtaaccccgttaaccgaaaccccggg

SEQ ID NO: 354652 - DNA, 614 bp, Homo sapiens
  misc_feature: GZ8MTXP01B7FOZ.21.35.D02.1.454.CMB.2.raw
  modified_base (253)..(253): a, c, t, g, unknown or other
  misc_feature (253)..(253): n is a, c, g, or t
  modified_base (297)..(297): a, c, t, g, unknown or other
  misc_feature (297)..(297): n is a, c, g, or t
  modified_base (473)..(473): a, c, t, g, unknown or other
  misc_feature (473)..(473): n is a, c, g, or t
  modified_base (493)..(493): a, c, t, g, unknown or other
  misc_feature (493)..(493): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgtactttgccatcgcacgtcgggtccnccagactccgaggcgaaggggctagaggtgcgtggactagttancgctattcgagtggaagcgaattatgtactgtcggacggtacctcggtaggaacgggcctacttccacatccacaagaacaactaaactaccaaagacacgtcttgtttacagactaagtgagtcaagaccgtaaaggaaagaacgaggactacggtatagtaatacgtaacgtgngacgacgtagtacttaattnttagtgttacggaggtaactagttagacgttacgggtacgggtccgaacgggttacccttgggtaacccgtacccgttccgtcccgtaccgacccggtccccttaacccggtaaaccccgg

SEQ ID NO: 354653 - DNA, 605 bp, Homo sapiens
  misc_feature: GZ8MTXP01EVW71.21.35.D02.1.454.CMB.2.raw
  modified_base (290)..(290): a, c, t, g, unknown or other
  misc_feature (290)..(290): n is a, c, g, or t
  modified_base (564)..(564): a, c, t, g, unknown or other
  misc_feature (564)..(564): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccgcagacctcgaggcaaggggctagagtggctggactagttancgctattcgatggaagcgtatatgtactagtgcggactcgtagaacgggcctactccactagtcctaccgaaagaacaacctaaacttaccgaaagtaaccacggtcttgtttaccgagaactaaacgtggaacgacagaccgtaagaaaagaacgagtaccacggtactagtaaatactaacgtcgagacgtcggaacgttactttaagttattcgtagttacgaggtaacctagttcgaacgttacggtcggggaaccacggggttaccccnggtaacccacgtccttaccgcgacgtcccaaccgtaaccgg

SEQ ID NO: 354654 - DNA, 665 bp, Homo sapiens
  misc_feature: GZ8MTXP01DRXQS.21.35.D02.1.454.CMB.2.raw
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccactggtggagtcggggggagcgtgttccagcctgggacgtccctgagagtctcctgtgcagcctctggattcagcttcagtgactttgccatgctactgggtccgccagactccgaggcgaaggggctagagtggctggctagttatcgctatttcgagtggaagcgatatgtactatgcgactccggtagaggccgtacttccaactactctaccaaagtaacaactaaactttaccgaaaggaaacctacggtctttacgggtttactacgaactaaaagtgaacgcaagtaccgaagaaaaggaaacgaacggaacgtaaccgggacttaaggttaaacgttaaagtaaaccgttggtaacggccggtaaccgtaaaggttaacctttaaagtttaagtttagtacggttaccgaagggtaacctaagtttacgaaacgttacggtacggggaaccaaacgggttcccttagggtaaccctaaccgtccttccgacacgcccttaacccgaaacccgg

SEQ ID NO: 354655 - DNA, 644 bp, Homo sapiens
  misc_feature: GZ8MTXP01AJAYI.21.35.D02.1.454.CMB.2.raw
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
  modified_base (623)..(623): a, c, t, g, unknown or other
  misc_feature (623)..(623): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgtactttgccatgcacgtcgggtccgccagacctcgaggacgaagggctaggngtggctggctagttancgactagtttcgataggaagcgtatatgtactaagtcggaccggtacgtccggtaggaacggccgtacttccactacgtcctccgaaaagacgaactaaactacccgaaagacctacggtctttcgtttacagaacgtaaagtacgacgaccgaagacccgtaaaagggaaacgaaacggaacggaacgacgggcttaagttaataacgtaacgtgtcgacgtcggtaacgttaacctttaagtttaagttcgttacggtcgtaaacgggtaactgttacgacgttcgggtacgggaacgacggttacccttgggaaccctcgtctccncgaccgtcccaacgaacccgg

SEQ ID NO: 354656 - DNA, 673 bp, Homo sapiens
  misc_feature: GZ8MTXP01EE762.21.35.D02.1.454.CMB.2.raw
  modified_base (254)..(254): a, c, t, g, unknown or other
  misc_feature (254)..(254): n is a, c, g, or t
  modified_base (300)..(300): a, c, t, g, unknown or other
  misc_feature (300)..(300): n is a, c, g, or t
  modified_base (498)..(498): a, c, t, g, unknown or other
  misc_feature (498)..(498): n is a, c, g, or t
  modified_base (508)..(508): a, c, t, g, unknown or other
  misc_feature (508)..(508): n is a, c, g, or t
tcagtcgtcgctcgcacgaccggtgctcgatttagcacacgatagttggggtttgggggggaagaggaagactgacggtcctgccacaggtggtgctgggcacggtgggcactcgacacaacatttgcgctccactgtcaggtccacctggtggaggtcggggggagcgtgttccagcctgggacgtccctgagagtctcctgtgcagcctctggattcagtcttcagtgtacttgccatgcacgtggggtccncacgtctccgaggacgaaggggctaggagtggcgtggactagttancgctagttcgaagtggaaagcgtaattatacgtactagtcggaccggtaccttccggtaggaacgggtcctaaccttaccaacgtatccctacgaaagtaaacgtaactaaacgttaacccgaaacgtaacctaccgttctttaggtttacccgtataactaaaagcgaacgacgacgtacgtaaagaaacgacgganaccggacgtntaagtaataacgtacggttgacgacggtacgttaacggtattttaaatcgttagttacggttacgaacggttaactagttacggacgttacgggtcgggaaaccttacgggttccttacgggtaaccctacgccttccgacgacctccccgttaacgaacccggg

SEQ ID NO: 354657 - DNA, 661 bp, Homo sapiens
  misc_feature: GZ8MTXP01A5USB.21.35.D02.1.454.CMB.2.raw
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgtactttgccatgcacgtcgggtcccgcagactcgaggcgaagggctaggagtggctggcagttancgntagttcgatggaagcgtaatagtgtactagtggaccggtactccggtaggaaacggggcctaacttccgacctatcccaccgaaagaacgaactaaacttacccgaaaggtaaccctacggtcctttaggttttactacggaacctaaattaggacgacgaacgtaccgtaaaggaaaagaacgggaacgacgaacgggtacttagtaacttaagtaacgtggacgacggacgtacgttacgtttaattagttagtcggttacgaagggtaacctaagttacggacttacgggtcgggaacccgttacgggttcccttcggttaacccaccgtcctcccgacaccgtccccgttaacccgaacccgg

SEQ ID NO: 354658 - DNA, 595 bp, Homo sapiens
  misc_feature: GZ8MTXP01DMZ20.21.35.D02.1.454.CMB.2.raw
  modified_base (248)..(248): a, c, t, g, unknown or other
  misc_feature (248)..(248): n is a, c, g, or t
  modified_base (353)..(353): a, c, t, g, unknown or other
  misc_feature (353)..(353): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccnccagactccaggcaaggggctagagtggctggctagttatcgctattcgagtggaagcgatatgtactatgacgactcgagaaggccaacttcacatcaccaaanaaactaataccaaagaaccacgtccttgtttacagacaaatgaagcaagacctaagaaagaagaggacacggtctagtaataacgtaacgtgtcgacgacggtaacgtacctttaagttaacgttagtacggttaccgaaacgggacctaagtttacgacgtacggttcggggaccctaacgggaacccttggttaccaacccggtcctcctcaccgttccctaacccgaaccgtaacccgg

SEQ ID NO: 354659 - DNA, 695 bp, Homo sapiens
  misc_feature: GZ8MTXP01BITYL.21.35.D02.1.454.CMB.2.raw
  modified_base (589)..(589): a, c, t, g, unknown or other
  misc_feature (589)..(589): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgaccttgggttttcctcgttgctattttaagaggtgtccactgtcaggtccacctggtggaggtcgggggagcgtgttccagcctgggactcctgagagtctctgtgcagtcctctggacttcgagtcctttcgagtcgtacttcgccagttcgctacgtcgggtcccgccagacctcgacggcgaagggggctaggaggtggactggctagttactcggctagttccgaagtacgggaagtaccgtaattaaagtacgttaacgtaagttccgggaccgggtaccgttacccgggtagggaaacgggggtcccctaagttccaacccgtattccgtaccgaagtaacgaaacctaaattacccaaaggaacctacgtacttgtttcgaagacgtaaagtgacgccgaagtaccgaaagaaagtacggaacggaacaaccgggtnttaagttaactaaacgttaacggtcggttacggacgttaacggttaacggttaacccttttaaagttaagtttacgtacgggttacgtaaacggggttccttaaag

SEQ ID NO: 354660 - DNA, 647 bp, Homo sapiens
  misc_feature: GZ8MTXP01EB12P.21.35.D02.1.454.CMB.2.raw
  modified_base (253)..(253): a, c, t, g, unknown or other
  misc_feature (253)..(253): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgtccagcctgggactccctgagagtctcctgtgcagcctcgtggattcagtcttcagtgtactttgcctatgctacgtcgggtcccncagacctcgaggcgaaggggctaggagtggctggactagtactcgctagttcgagtaggagcgtatagtgtactagtcggccggtactcgtagacgggcctacgtacactctcctaccgaaagacgtaacactacgaaacgactacgtctgttacacgtaactaaagtcgaacgtcaacggtaccgtaaaggaaacgaggaacggaaccgaggtaacttaggtaacttaacgtagtagcgggtacgtaacggtacggttaacttagtttacgttagtcggttaaccgagggtaacctagttacggtaccgttacggggtacgggaccgttaacgggttcccttacggtaaccgtacccgtcctacgtacgacctaaccccgttcgtaaccccgg

SEQ ID NO: 354661 - DNA, 753 bp, Homo sapiens
  misc_feature: GZ8MTXP01B9E4T.21.35.D02.1.454.CMB.2.raw
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
  modified_base (349)..(349): a, c, t, g, unknown or other
  misc_feature (349)..(349): n is a, c, g, or t
  modified_base (373)..(373): a, c, t, g, unknown or other
  misc_feature (373)..(373): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgaccttgggttttcctcgttgcttcttttaagaggtgtccactgtcaggtccaccgtggtggaggtcgggggagcgtgttccagcctgggacgtcctgagngtctctgtgcagcctntggacttcagtcttcgagttcgtacttgacctatcgcctacggtcgggtccccgcgagacctccgaggacggaacgggggtctaaggnggtcggcgttaggctaagtttacnccggtactacgtttaccggagttaggaagtcgtaattaagttagtaacgtagtcgggaccggtacgtaccgggtagggaaacgggtccctaacgtttacccaaccgtacttaccgtaccgaaagtaaacgtaaacctaaacttacccgaaaacgtaacctaaccgttcgtttacgtttacgtaacgtaaacgtaaacgttacggaacgaccgtaacgaaccgttaaaggaaaacgtaagggaaacgggtaaccgtaacgggtaacttaaggttaaactaacgttaaacgtacgggtacgttaccgggttacgttaaacggttaaccctttagtttaacgtttaggtacgggtttaccgtaacgggttaaccgtttaacgg

SEQ ID NO: 354662 - DNA, 646 bp, Homo sapiens
  misc_feature: GZ8MTXP01DEFDF.21.35.D02.1.454.CMB.2.raw
  modified_base (251)..(251): a, c, t, g, unknown or other
  misc_feature (251)..(251): n is a, c, g, or t
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (307)..(307): a, c, t, g, unknown or other
  misc_feature (307)..(307): n is a, c, g, or t
  modified_base (361)..(361): a, c, t, g, unknown or other
  misc_feature (361)..(361): n is a, c, g, or t
  modified_base (394)..(394): a, c, t, g, unknown or other
  misc_feature (394)..(394): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggggggctgttccagcctgggacgtccctgagagtctcctgtgcagcctctggattcagctttcagtgactttgccatgcactggggtcccncagactcgaggcgaagggctagagngctggctagttancgntattcgagtaggaancgatatgtactatggacggactcgagaacgggcctattcccacatctcaagaanaacaactaacaaacgaaacacgtactcgttctntacaatagagacgacgacgaagaaagaaggaaggaacgacgacgtagtaagtaacgttaacgttaggtaggtacggaccggtaacggtaaccgtttaaacgtttaaatttaagtttacggttacgtaacgggtaaccgtaacgttacgttacgtaacggttacgggtaccgggtaaccgggaacccggttaccggttaccgtaacccgtaccgttccgtcctaccgttacctaacccgaacccgtaacccgg

SEQ ID NO: 354663 - DNA, 745 bp, Homo sapiens
  misc_feature: GZ8MTXP01AORZG.21.35.D02.1.454.CMB.2.raw
  modified_base (261)..(261): a, c, t, g, unknown or other
  misc_feature (261)..(261): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctcgtggattcgagtcttcagttcgtactttcgcctatcgctacgtcggggtcccnccacgacctcgaggacgaaggggctaggaggtggctggactagttatcgatattcgagtacggaagcgaatagtagtactagtggaccgtacgttccggtaggaacgggtccgtacttccgaacagtccctacgaaaagactaaccgtaaacttaacccgaaagtaaccgtaacgtctttacggtttacctacggaactaaagtcggaaacgtaccgaacggtacctaaaggaaaaaggaacggaacgggaacccgtaacgggtctaaaggttaataaacgttaacggtggtaccggacggtaccgtaaacggttaaccttttaagttaattagggttacgggttaccgtaaggggtaacccttaggtttacggtaccggttaccgggtacgggggtaacccgttaaccggggttaaccccgttgggtaacccctacccgttcgttacccgacgttaccggtccccttaaccggtaaccccggg

SEQ ID NO: 354664 - DNA, 698 bp, Homo sapiens
  misc_feature: GZ8MTXP01DQ0GW.21.35.D02.1.454.CMB.2.raw
  modified_base (253)..(253): a, c, t, g, unknown or other
  misc_feature (253)..(253): n is a, c, g, or t
  modified_base (278)..(278): a, c, t, g, unknown or other
  misc_feature (278)..(278): n is a, c, g, or t
  modified_base (295)..(295): a, c, t, g, unknown or other
  misc_feature (295)..(295): n is a, c, g, or t
  modified_base (360)..(360): a, c, t, g, unknown or other
  misc_feature (360)..(360): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagtcttcagtgtactttcgccatgcacgtgggtccncagactccgaggcaaggggctaggngtggctggactagttancgcagttcgagtggaagcgtaatatgtactagtgacgtactccgtaggacgggcctattccactntcctaccgaaagaacgaactaaacttacccgaaagtaacaccgtctttaggtttacacgtaacaaagtcgacgtacaacgtaccgtaaggaaaacgaaggaacggaacgacgggtactaaggttaattaaacgtaacggttagtacggaccggtaacggtaacggttaaacctttaaagtttagttagttacgggttaaccgaaggggtaacccttaagtttacgggtaaaccgttacgggtaccggggtaacccgaaacggggttaccccgttaggtaacccctaacccggttcctacccgtaccgaccgtaaccccttaacccgtaaaaccccggg

SEQ ID NO: 354665 - DNA, 689 bp, Homo sapiens
  misc_feature: GZ8MTXP01B68P5.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgtactttgccatgctacgtgggtccgccagacctcgaggcgaaggggctaggagtggcgtggctagttatcgctagttcgagtggaagcgaatatgtactagtggcggactccggtaggaacgggccgtattccgactacgtcctaccaaagaacgaactaaactacccgaaacgtaaccgacgtctttacgtttacacgtaacgtaaagtgaacgaccaaggtaacctaaagggaaaaggaaggaacggaacgaacgggtacttaaggtaattaagttaaacgtcggtacggacggtaaccggtaagttacctttaatttaagtttaggttcggtaccgtacgggtaacctagtttacggaaccgttacggggtacggggaccccgttaacggggttacccttcgggtaaccctaccccggttccttcccgcaacccgtccccgttaacccgtaaccccggg

SEQ ID NO: 354666 - DNA, 744 bp, Homo sapiens
  misc_feature: GZ8MTXP01ENX30.21.35.D02.1.454.CMB.2.raw
  modified_base (585)..(585): a, c, t, g, unknown or other
  misc_feature (585)..(585): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcatgttccagcctgggacgtcctgagagtctcctgtgcagcctctggattcagtcttcagtgtactttgccatcgcacgtgggtccgccagactccgaggacgaaaggggctaaggaggtggctgggctagttatccggctaagttcggaagtggggaaacgtcggtaattaagttacggtaccttaagtcggaccggtaccgtccgggttaggaacgggtaccccgtacttaccaaccctatcccgtaaaccgaagaacgtaaactaaacttacccgaaacgtaaccgtacgtctttacgttttaccagtaaccaaaagttcgggaactaccgtaaacgtaaccggtaaaggaaaaacggaacgggaaccgggtaacgtaccggggtatttaaacgggggttattaaaacgtttaaccgngggtacgaccggtacggtaacggttaaacttttaattacgttaggtttacggtcggaaaggtaccttaagggtcgttaaacggtcgggaacggggttaccgacgggttaaccctgggtacctaaccgttcctccgttaccgccgttaacccgtaacccg

SEQ ID NO: 354667 - DNA, 629 bp, Homo sapiens
  misc_feature: GZ8MTXP01AUWQK.21.35.D02.1.454.CMB.2.raw
  modified_base (249)..(249): a, c, t, g, unknown or other
  misc_feature (249)..(249): n is a, c, g, or t
  modified_base (270)..(270): a, c, t, g, unknown or other
  misc_feature (270)..(270): n is a, c, g, or t
  modified_base (272)..(272): a, c, t, g, unknown or other
  misc_feature (272)..(272): n is a, c, g, or t
  modified_base (284)..(284): a, c, t, g, unknown or other
  misc_feature (284)..(284): n is a, c, g, or t
  modified_base (448)..(448): a, c, t, g, unknown or other
  misc_feature (448)..(448): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccncagactcaggcaagggctagngnggctgcagttancgctattcgatggaagcgtatatgtactagtgcggtactccggtagaacggggcctattccactatcctacccgaaagaacaacctaaataccccaaaggaacccacggtcttgttacctagacaaagtgaacgcaagacctaagaaaggaacgaggacacggntagtaactaatacgtgcgcgacgtaagtactttaatagttagtcggttacgaacggggtaacctagttacgaaccgttacggtaccgggggacccaacgggggttacccccttaggggtcccctaacccgggttccgttacccccgtaccgttacccgtccccgttaaccccggaacccgg

SEQ ID NO: 354668 - DNA, 769 bp, Homo sapiens
  misc_feature: GZ8MTXP01EJVUU.21.35.D02.1.454.CMB.2.raw
  modified_base (297)..(297): a, c, t, g, unknown or other
  misc_feature (297)..(297): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagtcttcagtgtactttgccatgctacgtcgggtccgccagacctccgaggacgaaggggctagaggtggctggcagttancggctagttcgagtaggaagcgtaattagtagttactagtggaccgggtacttccgggtaggaaacggggtcctaacgtttccaacctacgtccctacccgaaaaggtaacgaaccgtaaactttaacccgaaaaggtaaacccctacggttactttacggttttaccgtacgtaaactaaagtcggaacgtctaaacggtaacccgtaaagggaaaaagaaacgggaaccggaaccgaacgggttaaccgttaaggttaaacggttaaacgttaaacggttgggtaccggtaccgggaaccggtaacgggttaaacccttttaaagtttagtttaacgttacggggtttacgtaacggggtaaccttagtttaccggtaacggttacggtcggggtaacccgacggggttaacccgttcggtcccgttacccgtcctcccgtacgacccgtcccgttaaccgaaccccggg

SEQ ID NO: 354669 - DNA, 627 bp, Homo sapiens
  misc_feature: GZ8MTXP01DLB07.21.35.D02.1.454.CMB.2.raw
  modified_base (246)..(246): a, c, t, g, unknown or other
  misc_feature (246)..(246): n is a, c, g, or t
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactccaggcaaggggctagagtggctggcagttancgntagtcgagtaggaagcgtatagtagtaactagtcggacggtactcggtaggaacgggtcctaacttaccaactactcctaccgaaagaacgaactaaacttaccgaaacgaaccgtacgtcttagtttactagaactaagtagacgacgacgacgtaagaaagaagaacggacgacgtacgtagtaagtaataacgtagtacgacgacgtacgtaacgttaattaagttagtacggtacgtaacggtaacgtaacgttagtacgttacggtacgggaccggacggttaccgttacgtaaccgtaccgtccgtcctccgacgtaacccgaaccgtaaccg

SEQ ID NO: 354670 - DNA, 753 bp, Homo sapiens
  misc_feature: GZ8MTXP01BKJM6.21.35.D02.1.454.CMB.2.raw
  modified_base (251)..(251): a, c, t, g, unknown or other
  misc_feature (251)..(251): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgccatgcacgtcgggtccnccagacctccgaggcgaaaggggctaggngtggctggctagttacncgactattcgagtaggaagcgtaattatgttaactagtcggaccggaccttccggtagggaaacgggccgtaacttcccgaacctatcccgtacccgaaaggtaaacgaacctaaacgtttacccgaaaacgtaaaccgtccgtacgtttacggttttaccctagtaaacccgtaaaaggttccggaaacggtaaccctaaagggtaccccgtaaagggaaaaacgggtaaagggaaccgggtaaacggaaccgggttacttaaggttaaacttaacgttaaaccgttggtacggtaccggccgtaaacgggttacccttttaaagtttaacttaggttacggttaccgaacgggtaactgttacggtacgttacggtccggggaacgttaccggggacccttcgggtaaccctccgttaacctccgtacgttaccgtcccgttccgaaaccccgg

SEQ ID NO: 354671 - DNA, 679 bp, Homo sapiens
  misc_feature: GZ8MTXP01BS85U.21.35.D02.1.454.CMB.2.raw
  modified_base (250)..(250): a, c, t, g, unknown or other
  misc_feature (250)..(250): n is a, c, g, or t
  modified_base (299)..(299): a, c, t, g, unknown or other
  misc_feature (299)..(299): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagtcttcagtgactttgccatgcacgtgggtccnccagactccgaggcgaaggggctaaggaggtggctgggactagtttacncgactagtttcgagtggaaagtcgtaattaagtggtaactagtcggaccgggtaaccttcccggtaaggaaacggggtccctaacttcccgaacctagttcccaacccgaaagaacgtaactaaattacccaaaaggaacctacgtctttgtttaccagaacctaaaagtggacgtacaacggtaccgtaaaggaaaagaaggaacggaacacggattagtaagtaattaacgtggacgtcggacgtacggttaacctttaatttagtaagtcggttacgaacgggtaacctagttcgtaacgttcggtacgggaccaacgggttacccttcggtaaccacccgttctaccgtccgaacgtccccgttaaccgaacccgg

SEQ ID NO: 354672 - DNA, 725 bp, Homo sapiens
  misc_feature: GZ8MTXP01EH5PV.21.35.D02.1.454.CMB.2.raw
  modified_base (216)..(216): a, c, t, g, unknown or other
  misc_feature (216)..(216): n is a, c, g, or t
  modified_base (532)..(532): a, c, t, g, unknown or other
  misc_feature (532)..(532): n is a, c, g, or t
  modified_base (691)..(691): a, c, t, g, unknown or other
  misc_feature (691)..(691): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccctgtcaggtccacctgggtggaggtcggggggagcgtgttccagccgtgggacgtccctgagagtctcctggtcgcagccttcgnggtattccgagtcttgcgttcgtacttttcgccctagtcggccgtaacgtcggggtacccgccaagacccgtaccggaggacgaagggggtctaggacggtggacgtggctagttatccgatagttacgagtaggagtcgtatagtaggtactagtcggcgggtacctccggtagccgggacctacgttccacgtagtcctaccgaaagtacgaacttaaaccgtacgaacgtaaccctgtacttcccgttaaatccgaaagtaacagggacaggaacgtaaccgtaagggaaacaacgggacgtacgaacggttntaaacgtatacgtacgtgacgacgtaacgtacgtttaagtagtttaacgtagggtctaacgggacggtaaactcggtttaacgggacccgtttagggggaccccggtacggttaaacccggttccggttccggtaaccccgttctaaccccgttacccncggttacccctaaccgggttaacccccaacgggg

SEQ ID NO: 354673 - DNA, 564 bp, Homo sapiens
  misc_feature: GZ8MTXP01EKZ6K.21.35.D02.1.454.CMB.2.raw
  modified_base (250)..(250): a, c, t, g, unknown or other
  misc_feature (250)..(250): n is a, c, g, or t
  modified_base (393)..(393): a, c, t, g, unknown or other
  misc_feature (393)..(393): n is a, c, g, or t
  modified_base (404)..(404): a, c, t, g, unknown or other
  misc_feature (404)..(404): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgtactttgccatgcacgtgggtccnccagactccgaggcgaaggggctaggagtggctggctagttatcgctattcgatggaagcgatatgtactatggcggtactcggtaggaacggcctattccacatcctacaagagaactaatccaaagacacgtcttgttacngacaaagtgancagactaagaaagagagacacggactagtatataactgtagcgagagtacttattatagtgttacgaggtaacctagttagacttacggcggggtaccacgggttacccttgggtaaccctaccggtcctccgacacgtccccgttaacccgaacccggg

SEQ ID NO: 354674 - DNA, 619 bp, Homo sapiens
  misc_feature: GZ8MTXP01CP6ZA.21.35.D02.1.454.CMB.2.raw
  modified_base (250)..(250): a, c, t, g, unknown or other
  misc_feature (250)..(250): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (301)..(301): a, c, t, g, unknown or other
  misc_feature (301)..(301): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcacgtgggtccncagactcaggcaagggctagagtgctggcagttancganatgagtaggagngtatatagtactagtcggacgtactccggaggaacggtcctaacctaccaactataccgtaccgaaagaactaactaaacttaaccgaaaacgactacgtcttacgttacagaaactaaagtgacgacaagacgtaaaggaaaagaaggacgaacgacgtactaagtaacgtaaataacgtgacgacgacgtaacgttaactttaaagttattagtagtacgaaggtaactagttagtacgttacggtacggggaaccgacggttacccttcggtaaccctacccgttccaccgtacgaccgtcccgaaccgaacccg

SEQ ID NO: 354675 - DNA, 708 bp, Homo sapiens
  misc_feature: GZ8MTXP01AMJZQ.21.35.D02.1.454.CMB.2.raw
  modified_base (252)..(252): a, c, t, g, unknown or other
  misc_feature (252)..(252): n is a, c, g, or t
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgtactttgccatgctacgtgggtccncagactccgaggcgtaaggggctaggagtggctgggctaggttancgctattcgataggaancgtaatatgtaactagtcggtaccggaccgttccggtaggaaaccggggtcctaatttcccgacctaactccgtacccgaaagaacgtaacctaaacgttacccgaaagaacctacggtctttagtttcctagaactaaagtgacgtacaacgtaccgtaagaaaacggaaggacgaacgacggtactaagtaataacgtaacgttggtacggaccgtggtaaccggttacctttaaagtttagtttaggtacgggttacgaacgggggttaacctaaggttcggtaacgttaaccgggtcgggggtacccttaacgggggttaccccgttacggggttccctacccgggttccctcccgtaccgttaccgcccccgttaaccgaaccccgggg

SEQ ID NO: 354676 - DNA, 631 bp, Homo sapiens
  misc_feature: GZ8MTXP01BS884.21.35.D02.1.454.CMB.2.raw
  modified_base (250)..(250): a, c, t, g, unknown or other
  misc_feature (250)..(250): n is a, c, g, or t
  modified_base (293)..(293): a, c, t, g, unknown or other
  misc_feature (293)..(293): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcgggggagcgtgttccagcctgggacgtcctgagagtctcctgtgcagcctctggattcagtcttcagtgtactttgccatgcacgtgggtccnccagactcgaggcgaaggggctagagtggctggactagttacncgactagttcgagtaggaagtcgtaattagttagtaacgtagtcggaccggtacgtacggtaggaacggcctactccaactatccacaaagaacaactaaactaccaaagactacgtcttacgttacagaactaagtgacacagacgtaaagaaagagacgacgacgtatagtaataagtaacgtgtacgacgacgtaacgtaactttaattagttagtcggtacgaaggtaactaagttacgtaacgttacgggtacggggtaccgttaacgggttacccttcggtaacccgtaccgttcctacccgtacgttacccgtcccgttaacccgtaaccg

SEQ ID NO: 354677 - DNA, 637 bp, Homo sapiens
  misc_feature: GZ8MTXP01APCT1.21.35.D02.1.454.CMB.2.raw
  modified_base (255)..(255): a, c, t, g, unknown or other
  misc_feature (255)..(255): n is a, c, g, or t
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (311)..(311): a, c, t, g, unknown or other
  misc_feature (311)..(311): n is a, c, g, or t
  modified_base (322)..(322): a, c, t, g, unknown or other
  misc_feature (322)..(322): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagccgtgggacgtccctgagagtctcctgtgcagcctctggattcagtcttcagtgtactttgccatgctacgtcgggtccnccagactccgaggcgaagggctagagtggctggctagtncgntattcgatggagtnatatgtactancgcgtacgtccggtaggacggctactcactatctacaagacaacaattacccgaaagacctacgtcgttgtttaccagaactaaaacgtggaactccgagtaaccgtaaaggaaaacgaaggtaacgaccacggtacttagtaataacgtaacgtgacggcgtaacgtacggttaacttaagttaacgttcgtggtttaccgaagggttaacctgttaccgtacgttacggtcggggaacccgttacggggaaacccctttcggaacccacccgttccgtcccgcgttaacccgccccgttaaccgtaaccccgg

SEQ ID NO: 354678 - DNA, 700 bp, Homo sapiens
  misc_feature: GZ8MTXP01B0CNP.21.35.D02.1.454.CMB.2.raw
  modified_base (262)..(262): a, c, t, g, unknown or other
  misc_feature (262)..(262): n is a, c, g, or t
  modified_base (309)..(309): a, c, t, g, unknown or other
  misc_feature (309)..(309): n is a, c, g, or t
  modified_base (427)..(427): a, c, t, g, unknown or other
  misc_feature (427)..(427): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctccgtgtgcagcctctggtacttcagtcttcagttgtactttcgcctatcggactacgtcgggtcccncacgacctccgaggcgaaaggggtctagagtggcgtggctagttacncgctagttcgagtaggagcgtaatagtagtacgtagtcggacggtacgtacggtacggaacggtcctacttaccacgtactccgtaccgaaagtacgtaactaacgttacccgaaaanacgtaccgtgttacgtttacagtaacaaagttcggatacgtagaccgtaaagaaacgtaacggacgaacgacggtattacgtaagttacgtacggttacgtcggaccggtaccggtaacgtttacgtttaagttacgtttaaggtcgggttaacaacggggtaacttaaggttacgtacggttacggtaccggggtacgaaccgggttacccgttcggtaacccgtaccgttcctacccgtacgttacccgtcccgttaaccgaaaccccggg

SEQ ID NO: 354679 - DNA, 739 bp, Homo sapiens
  misc_feature: GZ8MTXP01AF298.21.35.D02.1.454.CMB.2.raw
  modified_base (252)..(252): a, c, t, g, unknown or other
  misc_feature (252)..(252): n is a, c, g, or t
  modified_base (301)..(301): a, c, t, g, unknown or other
  misc_feature (301)..(301): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggactccctgagagtctcctgtgcagcctctggattcagtcttcagtgactttgccatgcacgtcgggtcccnccagacctccgaggacgaaggggctaaggaggtggctgggctagttacncgctaattcgagtcggaagcgtatagtgtactatcggcggtactccggtaggacgggcctataccactactcctaccgaaagtaacaaccgtaaattacccgaaaaggtaacctaccggtacgttcgttttacgacgtaacgtaaagttcggaacgaaccgtagaacccgttaaaggaaaaacggaagggaaacgggaaccgtaaccgggtacttaacgggttaaacggttaaacgtaaaccggttggtaacgggtaccggtaacccgggtaaaggttaacccttttaaagtttaagtttaggttaacggtttacggaacgggttaaccctaaggttacggtaccgacgggttacggggacccgttaacggggttacccgttcgggtaaccctaccgtcccgttaccgacccgaccgtcccgttaaccgaaccccggg

SEQ ID NO: 354680 - DNA, 776 bp, Homo sapiens
  misc_feature: GZ8MTXP01BSO8E.21.35.D02.1.454.CMB.2.raw
  modified_base (253)..(253): a, c, t, g, unknown or other
  misc_feature (253)..(253): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggactccctgagagtctcctgtgcagcctctggattcagtcttcagtgtactttgcctatgctacgtcgggtccncagacctcgaggcgaaggggctagagtggctggctagtacncgctagttcgagtggaagtcgaattagtacgtacttagtcggaccggtaccgttccggtagggaaccgggtaccgtaactttcccaaccgtaagtccctaaccgaaacgtaaacgaaccttaaacttaccccgaaaagtaacccgtaccggttctttaggtttactacggtaaacctaaaggttcggaacgtaccgaacggtacccgtaaaagggaaaacggtaaacgggaacgggaaaccgtaaccgggtacttaggtaacttaaacgttaaccggttggtacggaccggtaaccggtaacggtttaacctttaatttagttaacggttacggttaaccggaaagggtaacccttaaggttcggtaaacccgttaacggggtaccggggtaacccggttaacggggttaccccgttacggggtaacccctacccggttccctacccgtaccgaacccgtccccgttaacccggaacccggg

SEQ ID NO: 354681 - DNA, 650 bp, Homo sapiens
  misc_feature: GZ8MTXP01AWLUK.21.35.D02.1.454.CMB.2.raw
  modified_base (251)..(251): a, c, t, g, unknown or other
  misc_feature (251)..(251): n is a, c, g, or t
  modified_base (295)..(295): a, c, t, g, unknown or other
  misc_feature (295)..(295): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagccttctggattcagcttcagtgactttgccatgcacgtcgggtccnccagactccgaggcaaggggctaggagtggctggctaggttacncgctagttcgagtggaagcgtattatgtactagtcgcggtacttccggaggaacgggtcctacttccgactatcctaccgaaagaacgtaactaaacttaccgaaagaccgacgtcttacgtttacacgactaaaagtcggaacgcaacggtaccgtaaggaaaacggaacggaacggtaaccgaccgggtattaaggtaattaactaaacggtgtaccgacgacgtaacggttaaccttagtttagttaagtcggttacgacggtaactagttcgaaccgttacgtacggggaccttacgggttaccgttggtaacccaccgttccgtaccgcaccgtcccgttaacgaacccg

SEQ ID NO: 354682 - DNA, 625 bp, Homo sapiens
  misc_feature: GZ8MTXP01EVFLX.21.35.D02.1.454.CMB.2.raw
  modified_base (253)..(253): a, c, t, g, unknown or other
  misc_feature (253)..(253): n is a, c, g, or t
  modified_base (328)..(328): a, c, t, g, unknown or other
  misc_feature (328)..(328): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccactggtggaggtcggggggagcgtgttccagcctgggacgtcctgagagtctcctgtgcagcctcgtggattcagtcttcagtgtactttgccatgcacgtcgggtccncagacctcgaggacgagggctaggagtggcgtggctagttactcgactagttcgagtaggaagctatatgtactntcggacggtactcggaggacggacctacttccactactcctaccgaaagacaactaaactaccgaaacgacgtacgtcttacgtttaccagaactaaatggacgacgaacggacgtaaaggaaagagtaacggacacggtataggtatagtaacgtgtacgacgtagaacgttacttaagttcttaggtgttacggagtaactagttcgaacgttcggtacgggaccgttaacgggttaccttcggtccctaccgttaacccgcccttaggaccctcccgttaacccgaacccgggg

SEQ ID NO: 354683 - DNA, 628 bp, Homo sapiens
  misc_feature: GZ8MTXP01BU43R.21.35.D02.1.454.CMB.2.raw
  modified_base (489)..(489): a, c, t, g, unknown or other
  misc_feature (489)..(489): n is a, c, g, or t
  modified_base (606)..(606): a, c, t, g, unknown or other
  misc_feature (606)..(606): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgtactttgccatgctacgtcgggtccgccagactccgaggcgaaggggctaggagtggcgtggctagttactcgactagtttcgagtggaagcgtaagttatgtaactagttcggaccggtaccgttccggtaggaaccggggtcctacttccaccgtatcccgtaccgaaaagaacgaactaaacttacccgaaacgaacctacgtcttacgtttacacgataaagtggacacgagtaccgtaaaggaaagacgacggaacncggtacttagtaatacgtactggcgacgtagtacgtactttagttacgtatcggtacgcgggtaactagttcgacgttaggtcgggacaccgggttccttcggaacctccgtctccncgacgtcccgttaacgaaccgg

SEQ ID NO: 354684 - DNA, 624 bp, Homo sapiens
  misc_feature: GZ8MTXP01EBX4N.21.35.D02.1.454.CMB.2.raw
  modified_base (249)..(249): a, c, t, g, unknown or other
  misc_feature (249)..(249): n is a, c, g, or t
  modified_base (292)..(292): a, c, t, g, unknown or other
  misc_feature (292)..(292): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggactcctgagagtctcctgtgcagcctctggattcagtcttcagtgtactttgccatgcacgtcgggtccncagactccgaggcgaagggctaggagtggctggactaggttancgactagttcgagtggaagcgtaattagtgtactagtcggaccggtacgtccgtaggaacgaccgtacttccaactatcccacgaaagaacaactaaacttacccgaaagtaaccacgttcttacgtttacagaacaaatcggacacgaacgtaccgtaaaggaaaggaacgaggaaaccgaggtacttaggtaataacgtaacgtgtacgacggtaacgtaacgttactttaatttacgtagttacggtacgaacggtctaagttcgacgttacggacgggtaacacggttccttgcctacccgctcgacgactcccgttaacgaacccgg

SEQ ID NO: 354685 - DNA, 651 bp, Homo sapiens
  misc_feature: GZ8MTXP01B99LR.21.35.D02.1.454.CMB.2.raw
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctcgtggattcagcttcagtgtactttgccagtgctacgtcgggtccgccagacctccgaggcgaaggggctagaggtggctggctagttatcgctagttcgagtggaagcgtatatgtactagtgcggtacgtcgtggaacggtccgtacttccacatccaccaagacgaactaacttacccaaagtaccgacgtcttagttctagaacaaagtgacgcacgaccgtaagaaacgaggaacggacacggtacttaggttaataacgtacgttaggtacgaccgtacggtaacgttaccgtttaagttaagtttaggttacggttaccggtaagggtaacccttagttacggtaacgttacggggtacggggacccgttaaccgggttccgttcggtccctaccgtcctacccgtcgaccgtccccgttaaccgtaaccccggg

SEQ ID NO: 354686 - DNA, 690 bp, Homo sapiens
  misc_feature: GZ8MTXP01BTZLR.21.35.D02.1.454.CMB.2.raw
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggagcgtgttccagcctgggactccctgagagtctcctgtgcagcctcgtggattcagtcttcagttgtactttgcctatgctacgtcggtccncagactcgaggcgaagggctaggagtggctggactagttancgactagttcgagtaggaagtcgtaattactggttaactagtcggaccggtacttccggtaggaacgggcctacttaccgacctatcctacaaaaggacaacctaaacttaacccgaaagaaccgtcgtacgtttagttaccagtaactaaacgtggacgtacaacggtaaccgtaaaggaaaacgacgggaaggaccgtaaccggtattaacgtaagttaaacgtaccgtagggacgaccggtaacgtaaccggttaactttaagtttacgttaaggtcggttaacggaacggtaactagttaggtaccgttacggtacggggaccgttacgggaacccgttcggtaacctccgtcctccgacgttacccgtaacccgttccgaaaccccggg

SEQ ID NO: 354687 - DNA, 526 bp, Homo sapiens
  misc_feature: GZ8MTXP01A3U24.21.35.D02.1.454.CMB.2.raw
  modified_base (246)..(246): a, c, t, g, unknown or other
  misc_feature (246)..(246): n is a, c, g, or t
  modified_base (322)..(322): a, c, t, g, unknown or other
  misc_feature (322)..(322): n is a, c, g, or t
  modified_base (373)..(373): a, c, t, g, unknown or other
  misc_feature (373)..(373): n is a, c, g, or t
  modified_base (517)..(517): a, c, t, g, unknown or other
  misc_feature (517)..(517): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccatgtcaggtccacctggtggagtcggggggagcgtgttccagcctgggacgtccctgagagtctcctgtgcagcctctggattcagcttcagtgactttgccatgcatgggtccncagactccaggcaaggggctagagtggctggcagtatcgcattcgatggaagcgatatgtactatgcggactccgngaagggccattcacatcgtccaagagaacaatccaaagaacacgctgttcngcaaatgagcagcctagaaagagaggacacggctgataataacgtgtcgcgcgaggaccttattagtatggttacaagggcccaagttgacttacgtggggcccttaaggggaccccttgggtcaccgtctacctcgacgtccncccgaaccg

SEQ ID NO: 354688 - DNA, 607 bp, Homo sapiens
  misc_feature: GZ8MTXP01BTIQU.21.35.D02.1.454.CMB.2.raw
  modified_base (254)..(254): a, c, t, g, unknown or other
  misc_feature (254)..(254): n is a, c, g, or t
  modified_base (274)..(274): a, c, t, g, unknown or other
  misc_feature (274)..(274): n is a, c, g, or t
  modified_base (311)..(311): a, c, t, g, unknown or other
  misc_feature (311)..(311): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (426)..(426): a, c, t, g, unknown or other
  misc_feature (426)..(426): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcggggggagcgtgttccagcctgggacgtccctgagagtctcctgtgcagcctctggattcagtcttcagtgtactttgcctatgctacgtgggtccnccagactccgaggcaagggntagagtggctggactagtatcgactattcgatggaangtaatagtgtaactagtggacggacttccgagaaacgggcctaattccaactatcctaccaaagaacaaccaaatacccgaaagtaaccacgtcttgtttacananaanagananacgacgaagaaagaagaagaacgacgtacgtagtaagtaataagtagtagacgacgtacgtaacttaattaagttaagtacgtacgtaagtaactaagttagtacgttacggtacggtaacgaacggttaccgttacgtaaccgtaccgtcctcctacgacgtaaccgttaaccgtaaccg

SEQ ID NO: 354689 - DNA, 701 bp, Homo sapiens
  misc_feature: GZ8MTXP01CEJDJ.21.35.D02.1.454.CMB.2.raw
  modified_base (256)..(256): a, c, t, g, unknown or other
  misc_feature (256)..(256): n is a, c, g, or t
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtcctgagagtctcctgtgcagcctctggattcagtcttcagttgtactttgcctagtcgctacgtcgggtccnccagacctccgaggacgaaggggctaggaggtggcgtggctagttacncgactattcgagtaggaancgtaatatgtactagtcggcggtactcggtaggaacggcctacttccactactcctaccgaaagtaacgaactaaacttaaccgaaagtaaccgtacgttctttacgtttaacgacgtaactaaaggtcgaacgtacgaacggaaccgtaaagggaaaacgaacggggaacgaaccgtaacgggtacttaaggttaacttaaacgtaacggtggtaccgggaccgtaacggtaacgggttaacttttaagttacgtttaacggtacggtacgaacggtaactaggttacgtaccgttacgggtaccgggaccgttaacgggttccttcggtaacccgtaccgtcctacgtcgacccgtcccgttaaccgtaacccggg

SEQ ID NO: 354690 - DNA, 583 bp, Homo sapiens
  misc_feature: GZ8MTXP01AVL4L.21.35.D02.1.454.CMB.2.raw
  modified_base (312)..(312): a, c, t, g, unknown or other
  misc_feature (312)..(312): n is a, c, g, or t
  modified_base (379)..(379): a, c, t, g, unknown or other
  misc_feature (379)..(379): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
  modified_base (552)..(552): a, c, t, g, unknown or other
  misc_feature (552)..(552): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctcgtggtattcagcttcagtgtactttgcctatcgctacgtcgggtcccgccagacctccgaggtacgaagggggtctaggagtggctgggctaggttactcgntagtcgagtggaagcgatatgtacatcggcggtacctcggtaggacgggcctacgttccacactccnccaaagacaactaaataccaaagacacgtctgttcnataagngagcagacaagaaagaggagacncgntagtaagtatacgtgacgacggcgtaacgttactttaattacttagtgtacgacggaactagttcgaacgttacggtcgggaccgttacggccgttggtaacccncgtcctcctacgccgtaacttcccgaaccgg

SEQ ID NO: 354691 - DNA, 553 bp, Homo sapiens
  misc_feature: GZ8MTXP01CMCBH.21.35.D02.1.454.CMB.2.raw
  modified_base (250)..(250): a, c, t, g, unknown or other
  misc_feature (250)..(250): n is a, c, g, or t
  modified_base (275)..(275): a, c, t, g, unknown or other
  misc_feature (275)..(275): n is a, c, g, or t
  modified_base (289)..(289): a, c, t, g, unknown or other
  misc_feature (289)..(289): n is a, c, g, or t
  modified_base (327)..(327): a, c, t, g, unknown or other
  misc_feature (327)..(327): n is a, c, g, or t
  modified_base (530)..(530): a, c, t, g, unknown or other
  misc_feature (530)..(530): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggactccctgagagtctcctgtgcagcctctggattcagtcttcagtgactttgccatgcacgtgggtcccnccagacctcgaggcaaggggctagngtgctggcagttancgcattcgatggaagcgatatgtactatgcggactcgngaggcctactcacatcaccaaagacgaacaacttaccaaagaaccacgtcttgtttcagacaaatgagacagactagaaagagagacacgtactagtaatataagtgtcgcgacgagtactttattatagttggtacgaagggtaactaagttgacgttcgtacggggccaacggggttcccttcggtcctaccgtcctaccncacgtcccttaacccgaacccgg

SEQ ID NO: 354692 - DNA, 628 bp, Homo sapiens
  misc_feature: GZ8MTXP01BAOSD.21.35.D02.1.454.CMB.2.raw
  modified_base (246)..(246): a, c, t, g, unknown or other
  misc_feature (246)..(246): n is a, c, g, or t
  modified_base (269)..(269): a, c, t, g, unknown or other
  misc_feature (269)..(269): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (303)..(303): a, c, t, g, unknown or other
  misc_feature (303)..(303): n is a, c, g, or t
  modified_base (360)..(360): a, c, t, g, unknown or other
  misc_feature (360)..(360): n is a, c, g, or t
  modified_base (416)..(416): a, c, t, g, unknown or other
  misc_feature (416)..(416): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccncagactcgaggcaaggggctagngtggactggcagttacncgntattcgagtggaancgtaattagtcgtactagtcggacggtacttcggaggaacgggcctacttccacgtntccctaccgaaagaacgaactaactacccgaaagaacctacgtcttagttcagaanaagtagacgacgagacgtaagaaagaagaacggacgaacggacgtaagtaacgtaacgtagtacgacggacgtaacgtacgttaattaagttagttacgtacgtacggtacgtaacgtacgttacgtacggttacggtaccggtaacggaccgttcggttaccgtaacccgtccgtcctaccgaccgttacccgtaacccgaaccgtaaccg

SEQ ID NO: 354693 - DNA, 738 bp, Homo sapiens
  misc_feature: GZ8MTXP01BY6L9.21.35.D02.1.454.CMB.2.raw
  modified_base (253)..(253): a, c, t, g, unknown or other
  misc_feature (253)..(253): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctcgtggattcagcttcagttgactttgccatgcacgtcgggtccncagactcgaggcgaagggctagagtggctggctagtatcgntattcgagtaggagcgaatatagtactagtcggacggtactccggtaggaacgggtcctacttccgaacctagtcccacctaaaaggaacctaactaaacgtttaccgaaacggttaaaccaccgggtactttgttaccctagaactaaacgtgaacggtcaacggtaccgtaaaggaaacgaaacgggacggaaccgtaacgggtacgttaaggttaacggttaaaacgtttaaccgtagggttaacggtaccggtaacccggttaaaggtaacccctttttaaagtttaaccgttaggtttacggttacggtaaccggtaaacgtaacgttaccggtaacgttacgggtacggggtaaccgttaccgggttacccggttacggtaaccgttccccggtaacctcccgtaccgttaccgtccccgttaaccgtaaaccccggg

SEQ ID NO: 354694 - DNA, 692 bp, Homo sapiens
  misc_feature: GZ8MTXP01A1O0G.21.35.D02.1.454.CMB.2.raw
  modified_base (299)..(299): a, c, t, g, unknown or other
  misc_feature (299)..(299): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcgggggagcgtgttccagcctgggacgtcctgagagtctcctgtgcagcctcgtggattcagtcttcagtgtactttgccatcgctacgtcgggtccgccagactccgaggcgaaggggctaggaggtggctggctagttacncgctagtcgagtggaagcgtatagtgtactagtcggacggtacgtcggtaggacggggcctaacttccactagtcctaaccgaaagaacaactaaacttacccgaaaacgtaccgtacgtcgttactttacgacgaactaaagtaggacgacctaggtaaccgtaaaggaaaggaaacggacggaacaccggtagttaacgtagttaaacgtacgtaggtcgacggtaacggtaacggttacctttaagtttaacggttacgttacgggttacgaacgggtaacttacgttaacgggtacttaccggggtacgggtacggaaaccgggttcccggttaccgtaaccgtccggttcctccggtacaccgggtccccttaaccggtaaccccggg

SEQ ID NO: 354695 - DNA, 612 bp, Homo sapiens
  misc_feature: GZ8MTXP01EPW7B.21.35.D02.1.454.CMB.2.raw
  modified_base (255)..(255): a, c, t, g, unknown or other
  misc_feature (255)..(255): n is a, c, g, or t
  modified_base (280)..(280): a, c, t, g, unknown or other
  misc_feature (280)..(280): n is a, c, g, or t
  modified_base (297)..(297): a, c, t, g, unknown or other
  misc_feature (297)..(297): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcggggggaggcgtgttccagcctgggacgtccctgagagtctcctgtgcagcctctggattcagtcttcagttgtactttgccatgcacgtcgggtccncagactcgaggcgaaggggctaggngtggctggactagttancgatagttcgagtacggaagtcgtaattagtcgtactagtggaccggtacgtccggtaggaaacgggcctaacttccacatcctacgaaagacaactaaactaccgaaagacacgtcttacgtttcagactaaatgacgcgaagacgtaaagaaagaagacggacacggtatagtaacttaagtaacgtggtacgacgtacggtaaccgtactttagttacgttagtacggtacgaacggtaactagttcgaacttacgggtccgggacacgggttaccttcggtcaccgtctcaccgactccttaaccgaaccg

SEQ ID NO: 354696 - DNA, 776 bp, Homo sapiens
  misc_feature: GZ8MTXP01CZUP5.21.35.D02.1.454.CMB.2.raw
  modified_base (254)..(254): a, c, t, g, unknown or other
  misc_feature (254)..(254): n is a, c, g, or t
  modified_base (301)..(301): a, c, t, g, unknown or other
  misc_feature (301)..(301): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgtgctccactgtcaggtccacctggtggaggtcggggggagcgtgttccagcctgggacgtcctgagagtctcctgtgcagcctctggattcagtcttcagtgtactttgccatgcacgtcgggtcccnccacgacctccgaggcgaaggggctaggaggtggctggctagttacncgatagttacgagtaggaagcgtaatagtcgtactagtcggcggtacgtcggtaggaacgggtccgtacttaccgacctactacccgtacgaaaacgtaacgaaccttaaacttaaacccggaaaacgtaaacccgtaccgttccgtttacgtttaccgaagtaaacctaaaaggttcggaacgtaccgaaacgggtaaaccgtaaaggggaaaacggtaaacggggtaaccgaaccgtacggttaacgttaaggttaaactaaacggttaacgtgggtaccggaaccggtaaccggtaacgtttaacctttaaagttagttacggtacggtacgtaaacgggtaacttaacggttcggtaaacgttccggggtaaacgggtaacccggttaaaccgggttcccgttacggttaaccccgaacccgtttccgacccgtaccgacccggtaaccccttaacccgggaaaccccggg

SEQ ID NO: 354697 - DNA, 761 bp, Homo sapiens
  misc_feature: GZ8MTXP01A72UN.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtcctgagagtctctgtgcagcctctggattcagctttcagttgtactttgtcatgcacgtgggtccgcacgactccgaggtcgaaggggctagagtggctggactagttactcggctagtttacggagtagggaaagtcgtaattaagtggtaacttagtggtaccgggttaacctccgggtagggaaacgggggtcctaaccgtttacccaaactacgtttaccgacccgaaaagggtaaacgaaccctaaatttaaccccggaaaacgttaaaccgaccggttactttcggttttacccttacgaaataaacgttaggaaccggaccgtaacggaacccgttaaaggggaaaaaggaaacgggtaaccgggtaacccgaacgggttaaccttaggttaaagttaaaccgtaacggtggttaccggaccgtacggtaacggttaacccttttaaggtttattacggttacggttacgaagggtaaccttatttaaacgggcgttacgggcggggtaccgacgggttaccccgttgggtaacctccggtctcccgtcaccggtccttaaccgaacccg

SEQ ID NO: 354698 - DNA, 760 bp, Homo sapiens
  misc_feature: GZ8MTXP01BRAQ9.21.35.D02.1.454.CMB.2.raw
  modified_base (253)..(253): a, c, t, g, unknown or other
  misc_feature (253)..(253): n is a, c, g, or t
  modified_base (298)..(298): a, c, t, g, unknown or other
  misc_feature (298)..(298): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgtccagcctgggacgtccctgagagtctcctgtgcagcctctggattcagcttcagtgtactttgcctatgctacgtcggggtcccnccagacctccgaggcgaaggggctaggagtggctggctagttacncgactagttccgagtacggaagtcgtattagtagtacgtagtcggtaccggtaccttaccgggtaggaaacggggtcccgtaacttacccggaacctacgttaccccgttacccgaaacgggtaacggtaacctaaacgtttaccccgaaaagggtaaccctaccggttcgtttacgttttacccaggaactaaaacgtggaaacgtacgaacggtaacccttaaaggggaaaagaacgggaacggaaccgtaaccggggtacttaacggttaaattaacgttaaaccggttcggtacggtaaccggtacggaacggtttaacccttttaagttaaccgttagtcggttacgaggtaacctagttacggacgttacgggtaccggggacgttaaccgggttccgttacggtccctacccggttcctcccgtacgacccggtcccttaacccggtaacccggg

SEQ ID NO: 354699 - DNA, 755 bp, Homo sapiens
  misc_feature: GZ8MTXP01EGXAZ.21.35.D02.1.454.CMB.2.raw
  modified_base (290)..(290): a, c, t, g, unknown or other
  misc_feature (290)..(290): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagttgtactttgcctatgcacgtgggtccaccagactccgaggcgaagggctagagtgctgctagttancgactattcgatcggaagtctaatataggttactagtcggacggaccttccggtaggaacggaccgtacttaccgacagttcccgtacccaaaggaacaaccgtaaaactttacccgaaaacgtaaccgtaccgtacgtttacgtttacctagtaaccgaaaagttcggaacgccgaaaggtacccgtaaagggaaaagaaacgggaacggaaccgaacgggtacttaagttaaacggttaaagttaaacggtcggtacggacggtaaacccggttaagtttaaccgtttaaagttttaccgttaaggttaccgggtttaacgaaaccgggggtaacttaaacgtttcggtaaaccgttttaccgggacgggggtaacccgaaccgggttacccgttacgggtaacccgtaacccgtttcccgtcccgttaccgacccgggttccccaacccggtaaacccccgg

SEQ ID NO: 354700 - DNA, 632 bp, Homo sapiens
  misc_feature: GZ8MTXP01A350G.21.35.D02.1.454.CMB.2.raw
  modified_base (304)..(304): a, c, t, g, unknown or other
  misc_feature (304)..(304): n is a, c, g, or t
  modified_base (401)..(401): a, c, t, g, unknown or other
  misc_feature (401)..(401): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggacttcagtcttcagtgtactttgccatcgctacgtcggggtcccgccagacctccgaggtccgaaggggctaggacgtggctggctagttacncgactattcgagtacggaagcgtaatagtagtactagtggccggactccggtagaaggcctacttcgactatccacaagacaacaaactaccgaaanaacctcgtcttagttactgtaacaatagacacgagaccgtaaaggaaagtacgggacgaacgaacgggtataacgtagtaactacgtggtacggacgtacgaacggtttactttaagttagtaacggttagttacggaacgggtaactacgttcggtacgttacggtacgggaccgttaccggttcgttcggtccctacgtccctctccgacgtcccttaaccgaacccgg

SEQ ID NO: 354701 - DNA, 681 bp, Homo sapiens
  misc_feature: GZ8MTXP01AW26F.21.35.D02.1.454.CMB.2.raw
  modified_base (287)..(287): a, c, t, g, unknown or other
  misc_feature (287)..(287): n is a, c, g, or t
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccactggtggaggtcggggggagcgtgttccagcctgggacgtccctgagagtctcctgtgcagcctcgtggattcagtcttcagttgtactttcgccatgccacgtcgggtccgaccagacctccgaggcggaaggggctaggngtggctggctagttacncgctagttcgagtggaagngtatagtcgtactgtcggcggtacgtccggtaggaacgggtcctacttaccactatacctaccgaaagaacgaactaaactaacccgaaaacgtacgtacccgtgtttacgttactacgaactaaaagtgaacgacgacgaaccgtaaaggaaaagtaacggaacggacgtacggtactaagttaagtaacgtaagttggacgacggtaacggtaacgtttaactttaagttacgttagtacggttcgaacggtaacttaggttacgtacggttacggggtaccgggaccgttaacgggcccttcgggtaacccaccgttccctaccgcgttaacccgtcccttaaccggaaccccgg

SEQ ID NO: 354702 - DNA, 336 bp, Homo sapiens
  misc_feature: GZ8MTXP01EZGNB.21.35.D02.1.454.CMB.2.raw
  modified_base (336)..(336): a, c, t, g, unknown or other
  misc_feature (336)..(336): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctcgtggtatacagtcttctagtgtacgttcgcctatcgacacgtcgggtccgaccgtacgtaccgtacgacggacggaacgggtacgtaggtacggtacggtacgtacggtacgtacgttacgtaccn

SEQ ID NO: 354703 - DNA, 812 bp, Homo sapiens
  misc_feature: GZ8MTXP01B4UJX.21.35.D02.1.454.CMB.2.raw
  modified_base (190)..(190): a, c, t, g, unknown or other
  misc_feature (190)..(190): n is a, c, g, or t
  modified_base (225)..(225): a, c, t, g, unknown or other
  misc_feature (225)..(225): n is a, c, g, or t
  modified_base (280)..(280): a, c, t, g, unknown or other
  misc_feature (280)..(280): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggaggcgtgttccagcctgggacgtcccngagagtctcctgtgcagcctctggattcagccttnagtgactttgccatgcacgtcgggtccgccagactccgaggcaaggggctagagnggctggacaggttatcgacagtttcgagtaggaagcgtaatagtcgtactaagttcggccggtaacgtcccggttaggaaaacgggggcccgtaactttccaaaccgtattaccctacccgaaaagggtaaacaacccgtaaaatttaccccgaaaaggtaaaaccccaacggtcccgttaggtttttaccccaggaaccgaaaacttaaacggaaggaccaacggaacccgttaacggtaaaaacggaaaagggaaagggaaaccgaaccgggaccgttacgggttaaacttaaacgtttaaaacgttaaacggttggtaccggaacggtaaccggtaaacccggtttaaacgttttaaactttaagtttaagggtttacgttaacggggtaaccgtaaaccgttaggtacgttaaacggttacgggggttacccgggaacccggggttaacccggttaccggtaacccgttacccggtaacccgttcccgttacccttaccgaaccccgttaaccccgtaaacccccggg

SEQ ID NO: 354704 - DNA, 619 bp, Homo sapiens
  misc_feature: GZ8MTXP01AFB85.21.35.D02.1.454.CMB.2.raw
  modified_base (251)..(251): a, c, t, g, unknown or other
  misc_feature (251)..(251): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgtactttgccatgcacgtcgggtccncagcctccgaggcgaagggctagacgtggctggctagttatcggctagttcgagtggaagcgtatatgtactatggaccgacgtaccgtggaacgggccaacttccacgtactcctacccgaaagacgtaacctaaacttacccgaaagtaactacggtctttacggtttccagtacaaacgtgaacgcacgtacgaagaaaggaacggtaagacgacggctagtatacgtactgacgcggacgtaggtaccttagtagttatcggttacgcgggtaactagttcgtacacgggtcggggtaaccgacgggttccgttcgtaacccgacgttcctcccgtccgttaccgtaaccgccccgtaacccgg

SEQ ID NO: 354705 - DNA, 608 bp, Homo sapiens
  misc_feature: GZ8MTXP01EZ4PX.21.35.D02.1.454.CMB.2.raw
  modified_base (301)..(301): a, c, t, g, unknown or other
  misc_feature (301)..(301): n is a, c, g, or t
  modified_base (387)..(387): a, c, t, g, unknown or other
  misc_feature (387)..(387): n is a, c, g, or t
  modified_base (399)..(399): a, c, t, g, unknown or other
  misc_feature (399)..(399): n is a, c, g, or t
  modified_base (409)..(409): a, c, t, g, unknown or other
  misc_feature (409)..(409): n is a, c, g, or t
tcagtcgtcgctcgcacgaccggtgctcgatttagcacacgatagttgggtttgggggggaagaggaagactgacggtcctgccacaggtggtgctgggcacgggtgggcactcgacacaacatttgcgctccactgtcaggtccacctggtggaggtcgggggggaggcgtgttccagcctgggacgtccctgagagtctcctgtgcagcctctggattcagcttcagtgactttgccatgcacgtcgggtcccgccagacctccgaggcgaaggggctaggaggtggcgtggcagttancgcattcgatggagcatatgtactagtggacgactccgaggacggccgtaactccacactcacaagacgaactaactccaaagacncgtcttgttacngacaagtgancgaagactaagaaacgaagacggacacggtactagtaagtacgttaacgtaggtcgacgtcggtaacggttaccttaaatttacgtaaggttcggttacgaacgggtaactagttacgacgttacggtcggggaaccgttacggggaccttcggttaaccgaccgttcctcctacgcccgtaacccgttccgaacccgg

SEQ ID NO: 354706 - DNA, 657 bp, Homo sapiens
  misc_feature: GZ8MTXP01E1NQR.21.35.D02.1.454.CMB.2.raw
  modified_base (254)..(254): a, c, t, g, unknown or other
  misc_feature (254)..(254): n is a, c, g, or t
  modified_base (295)..(295): a, c, t, g, unknown or other
  misc_feature (295)..(295): n is a, c, g, or t
  modified_base (298)..(298): a, c, t, g, unknown or other
  misc_feature (298)..(298): n is a, c, g, or t
tcagtcgtcgctcgcacgaccggtgctcgatttagcacacgatagttgggtttgggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctcgtggattcagtcttcagtgtactttgccatgcacgtcgggtccncagactcgaggcgaaggggctagagtggctggactagttancgntagttcgagtaggaagtcgaattagtagtactacgtggaccggtaccgtaccggtaggaacggggtcctaaccgttaccaactagtacccaccgaaaaggaaccaactaaccttaacgaaacgaccacggttcttacggtttacagactaaaatggagacaacgtaccgaaaggaaagaacgaaggaccgtaggtatagtaaattacgaagttcgggaggaccgtaaggaccgtttaaagtttattaagttacgttggtacccgaagggtaacctagttcggaacgttacgggacgggacccgaacggttccgttcggtcccacggttccttccacgaccgtcccgaacgaaccccggg

SEQ ID NO: 354707 - DNA, 682 bp, Homo sapiens
  misc_feature: GZ8MTXP01AJ9X2.21.35.D02.1.454.CMB.2.raw
  modified_base (299)..(299): a, c, t, g, unknown or other
  misc_feature (299)..(299): n is a, c, g, or t
  modified_base (650)..(650): a, c, t, g, unknown or other
  misc_feature (650)..(650): n is a, c, g, or t
  modified_base (661)..(661): a, c, t, g, unknown or other
  misc_feature (661)..(661): n is a, c, g, or t
  modified_base (669)..(669): a, c, t, g, unknown or other
  misc_feature (669)..(669): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcgggggaggcgtgttccagcctgggacgtccctgagagtcctccgtgtgcacgcctcgtggattcagtcttcagtcgtactttgcctagtgcctacgtcggggtcccgacacgacctacccggaggcggaaggggtctaaggnggtcggcgtggactagttacgtcgctagtttcgagtggaagacggtattacgtaggtactaagcggtaccgacgtccggttaggacgggacctacgtaccactactacccgtacgaaagtacgaactaaacgttaaccgaaacgaccgtaccgttcttaggtttacacgaaactaagtagacgacgaacggtaacaagggaaacaagggacgtaccgtagggtacttacggaattaacgtaacgcggtacgacggtaacgtagttaacctttagtttacgttaggtaggttacggaggtaactaagttcggtaaacggttcggaccgggacgttcgttaccgttcgtaacncccgtctaccncgttaccnccgcccgtaaccg

SEQ ID NO: 354708 - DNA, 633 bp, Homo sapiens
  misc_feature: GZ8MTXP02IT0Q4.21.35.D02.1.454.CMB.2.raw
  modified_base (252)..(252): a, c, t, g, unknown or other
  misc_feature (252)..(252): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (377)..(377): a, c, t, g, unknown or other
  misc_feature (377)..(377): n is a, c, g, or t
tcagtcgtcgctcgcacgaccggtgctcgatttagcacacgatagttggggtttgggggaagaggaacgactgacgggtcctgccactaggtggtgctgggcacggtgggcactcgacacaacatttgcgctccactgtcaggtccactggttggagtcgggggagcgtgttaccagcctgggacgtccctgagagtctcctgtgcaggcctctggattcagcttcgagtgactttgccatgcactggtccncagctcagcaagggctagagtgctggcagttacncgnagtgagtggaagcgatatagtaactagtgcgtactcgtaggaacggctaataccactatccacagacactaactaccaaagacacgtnttacgtttacagactaaagtagaacgacgaacgacgtaaagaaaacgaaaggaaggtaccgaacggtacttaagttaaataacgttaaacgtagtacggacgaacggtaacggtaactttaagttaacgttacgtacggtacgaacgggtaacctagttacgtaacgttaacggtacggggtaccgtaaccgggtaacccgtacggtaaccgtacccgttaccgtaccgtaccgtaccgtacccgtaccgaaaccg

SEQ ID NO: 354709 - DNA, 552 bp, Homo sapiens
  misc_feature: GZ8MTXP02HS80U.21.35.D02.1.454.CMB.2.raw
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
  modified_base (297)..(297): a, c, t, g, unknown or other
  misc_feature (297)..(297): n is a, c, g, or t
  modified_base (307)..(307): a, c, t, g, unknown or other
  misc_feature (307)..(307): n is a, c, g, or t
  modified_base (335)..(335): a, c, t, g, unknown or other
  misc_feature (335)..(335): n is a, c, g, or t
  modified_base (359)..(359): a, c, t, g, unknown or other
  misc_feature (359)..(359): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccgccagactccaggcaaggggctagagtggctggcagttancgnatgatggangatatgtatngcgactcgagaggcatcacatcacaganactaataccaaagaacctacgctnttctgacaaatagagacagacgagaaagaaagaagacgacgacgtagtataataatagtagacgacgacgtacttaattaattaagttagtacgtaacggtaacgtacgttagtacgtaacgtacggtaccggacggtaaccgtacgtaaccgtaccgtaccgtcctaccgtaccgtacccgtacccgaaccg

SEQ ID NO: 354710 - DNA, 629 bp, Homo sapiens
  misc_feature: GZ8MTXP02G73XE.21.35.D02.1.454.CMB.2.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttancgctagttcgagtaggaagcgtatatgtaactagtcggacggactccggtaggaacggggcctacgttccacctatcctaccgagacgactaaacttaccaaagaacacgtcttgtttactgacaaatgacgcacgtacctaaggaaaagaaggaacggaccgacggtacgtagtaaataagtaaaccgtgtacggaccgacggtaacggttaacctttaagttaatttaggttacggttacgaacgggtaacctagttacgacttacggtacggggaccgaacgggtaacccgtggtaacccgtaccggtcctccgtacgaccgtaccctaccgaaacccgg

SEQ ID NO: 354711 - DNA, 675 bp, Homo sapiens
  misc_feature: GZ8MTXP02F3FE2.21.35.D02.1.454.CMB.2.raw
  modified_base (250)..(250): a, c, t, g, unknown or other
  misc_feature (250)..(250): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgccatgcacgtcgggtccncagacctcgaggcgaagggctaggagtggctggctagtacgcgactagttcgagtaggaagtcgtattagtcgtactagtcggaccggtacgtacggaggaaccggctactaccgactactctaccgaagaacgactaaactacgaaagaacctcgtactttgttaccagaaactaaagtgaacgacgaaacgtacgaaaggaaaacggaagacggaaaccgacgttagttaaagtaacgttaaacgtaccgtaggtacggtaccggtaaacggttaaacgtttaacctttaaggtttaagtacggttaacgggtaacggtaacggtaaccgttaaggtacggtaacccgtaaacggggtcgacccgttaaccggggtacctccggtaacctccgtactaccgactaccggaccctacgaaccgg

SEQ ID NO: 354712 - DNA, 516 bp, Homo sapiens
  misc_feature: GZ8MTXP02JC0GG.21.35.D02.1.454.CMB.2.raw
  modified_base (286)..(286): a, c, t, g, unknown or other
  misc_feature (286)..(286): n is a, c, g, or t
  modified_base (342)..(342): a, c, t, g, unknown or other
  misc_feature (342)..(342): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttancgcattcgatggaagcgatatgtactatgcggactcgtgaaggccattcaccatcncagagcaatccaagaacacgctgttctgacaaatgagcagcctagaaagaagaggacacggctagtatataactgtgacgacgagtaccttattaattataggttcaaggacctagttgacttacgtcggggccaagggaccctggccgtaccgtctcctcacgcctacaaccg

SEQ ID NO: 354713 - DNA, 511 bp, Homo sapiens
  misc_feature: GZ8MTXP02H707O.21.35.D02.1.454.CMB.2.raw
  modified_base (250)..(250): a, c, t, g, unknown or other
  misc_feature (250)..(250): n is a, c, g, or t
  modified_base (380)..(380): a, c, t, g, unknown or other
  misc_feature (380)..(380): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacattttgcgctccactgtcaggtccacctggtggagtcgggggaggcgtgttccagcctgggacgtccctgagagtctcctgtgcagcctctggattcagctttcagtgacttttgccatgcactgggtccnccagactccaggcaaggggctagagtggctggcagttatcgcatttcgatggaagcgatatgtactatgcggactccgtgaagggccattcaccatctccagagcaaattccaaagaacacgctgtttcngacaaatgagcagcctagaaagagaggacacggactagtaatataactgtgcgcgagacttatatatgtcagggactagttgactagtcgggaccaggaccctggtcaccgtctcctcacgcctaccaccg

SEQ ID NO: 354714 - DNA, 517 bp, Homo sapiens
  misc_feature: GZ8MTXP02GWIEP.21.35.D02.1.454.CMB.2.raw
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
  modified_base (342)..(342): a, c, t, g, unknown or other
  misc_feature (342)..(342): n is a, c, g, or t
  modified_base (369)..(369): a, c, t, g, unknown or other
  misc_feature (369)..(369): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccncagactccaggcaaggggctagagtggctggcagttancgcattcgatggaagcgatatgtactatgcggactccgtgaagggccatcacatcncagagcaatccaaagacacgctgttcngacaaatgagcagcctagaaagaagaggacacggactagtaatataacgtgtagcgacgaggtaccttattacttatggtacaggtaccagttagactagtcggggaccacggaaccctggccacgtctcctcacgccctaccaaccg

SEQ ID NO: 354715 - DNA, 518 bp, Homo sapiens
  misc_feature: GZ8MTXP02GIXQU.21.35.D02.1.454.CMB.2.raw
  modified_base (374)..(374): a, c, t, g, unknown or other
  misc_feature (374)..(374): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccattcaccatctccagagcaattccaaagacacgctgtttcngcaaatgagcagctagaaagaagagacacggctagtatataactgtgcgcgaggtaccttaattattatgttcgagggtaccattgactacgtcggggaccacgggaaccctggtccaccggtctcctcacgcctccgaacccg

SEQ ID NO: 354716 - DNA, 525 bp, Homo sapiens
  misc_feature: GZ8MTXP02FT6IU.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccaggcaaggggctagagtggctggcagttatcgcatttcgatggaagcgatatgtactatgcggactccgtgaagggccgattcaccatctccagagacaattccaaagaacacgctgtttctgacaaatgagcagcctagaaaagaagaggacacggctagtatataactgtagcgcgaggaccttattattatggttcagggaccattgactacgtcggggaccacgggaaccctggtccaccgtctcctcacgccctaccaacccg

SEQ ID NO: 354717 - DNA, 564 bp, Homo sapiens
  misc_feature: GZ8MTXP02JG1FA.21.35.D02.1.454.CMB.2.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccaggcaaggggctagagtggctggcagttancgcattcgatggaagcgatatgtactatgcgactcgtgaacgggccattcaccatcncagancaatccaaagacngctgttcagacaaatgancagactagaaagaagagacgacggactagtatataactgtcgacgacgaaggtacctttagttattagtggttacgaacgggtactagttcgaaccgtacggtacggggaccgtaacggggtaaccccgttggtaacccgtacccggtcctaccctccgaccggtccccttaccgaaaccccgg

SEQ ID NO: 354718 - DNA, 537 bp, Homo sapiens
  misc_feature: GZ8MTXP02GFN77.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgcatttcgatggaagcgatatgtactatgcggactccgtgaaggcgattcaccatctccagacgacaattccaaagacacgcttagtttctgcaaatgagcagcctagaaagagaggacacggctgtatataactgtagcgcgaggacctttagttaattagtggttacagggtacctagtttcgacttacgtcggggtaccacggggtaacccctggtccaccgtctacctcacgccctaccgaacccg

SEQ ID NO: 354719 - DNA, 538 bp, Homo sapiens
  misc_feature: GZ8MTXP02I7Q6X.21.35.D02.1.454.CMB.2.raw
  modified_base (247)..(247): a, c, t, g, unknown or other
  misc_feature (247)..(247): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactcgtgaagggccattcaccatctcagagacaattccaaagacacgctgtttctgcaaatgagcagcctagaaagaagaggacacggctagtatataactgtgacgcgaggacttattaattattggttacaggggtaaccagtttagacttaacgtcgggggaccaacggggaaccccttgggtaaccacccgtctccctcacgccctaccgaacccg

SEQ ID NO: 354720 - DNA, 557 bp, Homo sapiens
  misc_feature: GZ8MTXP02HIZJR.21.35.D02.1.454.CMB.2.raw
  modified_base (287)..(287): a, c, t, g, unknown or other
  misc_feature (287)..(287): n is a, c, g, or t
  modified_base (387)..(387): a, c, t, g, unknown or other
  misc_feature (387)..(387): n is a, c, g, or t
  modified_base (421)..(421): a, c, t, g, unknown or other
  misc_feature (421)..(421): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagactccaggcaaggggctagagtggctggcagttancgcattcgatggaagcgatatgtactatggcggtactccggtgaacggggcctattccacctatctaccagagacaattccaaagaacacgtctgtttcngacaaatgagacagactagaaagagagacacggntagtatataactgtagacgagacgtacttattattagtaggttacgaaggtacctagttagactacggtacgggaccgacgggtaaccctggtaaccgtaccgttccgtacctcgaccgtccctacccgaacccgg

SEQ ID NO: 354721 - DNA, 522 bp, Homo sapiens
  misc_feature: GZ8MTXP02IJL8S.21.35.D02.1.454.CMB.2.raw
  modified_base (246)..(246): a, c, t, g, unknown or other
  misc_feature (246)..(246): n is a, c, g, or t
  modified_base (284)..(284): a, c, t, g, unknown or other
  misc_feature (284)..(284): n is a, c, g, or t
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccncagactccaggcaaggggctagagtggctggcagttancgcattcgatggaagcgatatgtactatgcgactccgtgaagggcatcaccatctcagagacaattccaaagaccncgctgtttcngacaaatgagcagcctaggaaagaagaggacacggctagtaatataacgtgtacgcgcgaggtacctttattattagtggttacagggtaccagttgactacgtcgggccgaacgggaccctggccaccggtctcctcacgccctacaaccg

SEQ ID NO: 354722 - DNA, 552 bp, Homo sapiens
  misc_feature: GZ8MTXP02HT1CG.21.35.D02.1.454.CMB.2.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (351)..(351): a, c, t, g, unknown or other
  misc_feature (351)..(351): n is a, c, g, or t
  modified_base (378)..(378): a, c, t, g, unknown or other
  misc_feature (378)..(378): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttancgcattcgatggaagcgatatgtactatgcggactccgtagaaggccattcaccatcctcaaganaccaattccaaagaccacgctgtttcngacaaatgaagcagacctagaaagaagaggacacggactagtaataataactgtagcgagacggtactttagttattataggttacgagggtacctagttagacgttacgtaggggaccgtaacgggaaccctggtaaccgtaccgtactccgtacaccgtccctaccaacccg

SEQ ID NO: 354723 - DNA, 536 bp, Homo sapiens
  misc_feature: GZ8MTXP02G84ZB.21.35.D02.1.454.CMB.2.raw
  modified_base (397)..(397): a, c, t, g, unknown or other
  misc_feature (397)..(397): n is a, c, g, or t
  modified_base (521)..(521): a, c, t, g, unknown or other
  misc_feature (521)..(521): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagactccgaggcgaaggggctaggagtggctggcagttatcgcattcgatggaagcgatatgtactatggcggactccggtgaacgggccattcaccatctaccagacgacaattccaaagaacacgcttgtttctagacaaatgancagactagaaagaagagacgagactagtatataactgtgacgacgagtaccttatattagtaggtacgaggtactagttgacttacggtcgggaccgacgggtacctcggcgtaccgtctaccncgacgtcctacgacg

SEQ ID NO: 354724 - DNA, 528 bp, Homo sapiens
  misc_feature: GZ8MTXP02G1X0Q.21.35.D02.1.454.CMB.2.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (301)..(301): a, c, t, g, unknown or other
  misc_feature (301)..(301): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttancgcattcgatggaancgatatgtactatgcgactcgtgaagggccatcaccatctcagagcaattccaaagaacacgctgtttctagacaaatgagcagcctagaaagaagaggacacggctagtaatataactgtagcgacgagtacctttattattagtggttacaagggtacctagttgaactacgtacggggaccaacgggaaccctggtccacgtctcctcacgtccctaccaaccg

SEQ ID NO: 354725 - DNA, 576 bp, Homo sapiens
  misc_feature: GZ8MTXP02JR2KJ.21.35.D02.1.454.CMB.2.raw
  modified_base (248)..(248): a, c, t, g, unknown or other
  misc_feature (248)..(248): n is a, c, g, or t
  modified_base (290)..(290): a, c, t, g, unknown or other
  misc_feature (290)..(290): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccgaggcgaaggggctagagtggctggctagttancgctattcgagtggaagcgaattatgtaactagtggcggtactccgtaggaacgggccaattccaccatcctaccgaagacgacaattaccaaagaaccacgtactttgtttctagacaaatgagacagacctaagaaagaaggaggacgacggactagtaataataacgtgtacggacgacgacggtacttagttaattagtggttacgaggtacctagtcgactacggtacgggacgacggtacccgtggccgtaccgtctcctacgcgtaccctaccgaaccg

SEQ ID NO: 354726 - DNA, 624 bp, Homo sapiens
  misc_feature: GZ8MTXP02HLUS4.21.35.D02.1.454.CMB.2.raw
  modified_base (292)..(292): a, c, t, g, unknown or other
  misc_feature (292)..(292): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtcccgccagacctccaggcgaaggggctaggagtggctggctagttancgctattcgatggaagcgatatgtactagtggcggtactcggtagaaacggggccacttaccaccatcctaccaagacgactaacttaccaaagaaccacgtcttagtttcagacaaatgagacagactaagaaagaagaggacacggactagtaaattataacgtgtaggcgacggaacgttacctttaagttaattagtacggttacgaacgggtaacctagttacgtaacgttacggtacgggggtaccgttaaacggggtaaccccgttcggtaacccgtaccggttaccttacccgtaccgtaccgtccccgtaacccgaaacccgg

SEQ ID NO: 354727 - DNA, 572 bp, Homo sapiens
  misc_feature: GZ8MTXP02FVD45.21.35.D02.1.454.CMB.2.raw
  modified_base (248)..(248): a, c, t, g, unknown or other
  misc_feature (248)..(248): n is a, c, g, or t
  modified_base (351)..(351): a, c, t, g, unknown or other
  misc_feature (351)..(351): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtgaagggccattcaccatctccagancaattccaaagaacacgctgtttctgcaaatgagcagctagaaagaagagacaggctagtaataacgtaactgtcgacgacgaacggtactttaatttaattagtacggttacgaacgggtacctagttacgtacgtacggtcggggaccgaacgggtaacccgttcgggtaacctaacccggttccctaccgttacaccggtaccctacccgaaacccgg

SEQ ID NO: 354728 - DNA, 571 bp, Homo sapiens
  misc_feature: GZ8MTXP02HA4NG.21.35.D02.1.454.CMB.2.raw
  modified_base (286)..(286): a, c, t, g, unknown or other
  misc_feature (286)..(286): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttancgcattcgatggaagcgatatgtactatgcggactccgtaggaacggggccgattccacctatcctaccagaacgacaaattaccaaagaaccacgctgtttctgacaaatgagcagctagaaagaagagacacggactgtaatataactgtgacgcgaaggtaacctttattaattagtggttacgaacgggtacctaagtttcgaactacggtacggggaccaacggggtaacccctgggtaaccacccggtacctcctaccgacgtcccctaccaaacccgg

SEQ ID NO: 354729 - DNA, 630 bp, Homo sapiens
  misc_feature: GZ8MTXP02HVXTH.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactggggtcccncagactccgaggcgaaggggctaggagtggctggcagttatcgctattcgagtggaaagcgaatatgtaactagtggaccggactccggtaggaaacgggccgtaacttaccaacctatcctacgaagaagactaaattaccaaagaaacctacgtcttagtttcagacaaagtagacgacgacgacgtaagaaagaaagaacggacgaacgacgtagtaataataagtagtagacgacgaacggtaacgttaagtttaagtttaagttagttacgtaacggtaacgtaacgttacgtaacgtaacggtacgggaccggaaccggtaacccggtacggtaaccgtaccgtaccgtacctaccaccgtaccctacccgaaccg

SEQ ID NO: 354730 - DNA, 505 bp, Homo sapiens
  misc_feature: GZ8MTXP02HPAEQ.21.35.D02.1.454.CMB.2.raw
  modified_base (247)..(247): a, c, t, g, unknown or other
  misc_feature (247)..(247): n is a, c, g, or t
  modified_base (406)..(406): a, c, t, g, unknown or other
  misc_feature (406)..(406): n is a, c, g, or t
  modified_base (422)..(422): a, c, t, g, unknown or other
  misc_feature (422)..(422): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtgaaggccgattcaccatctccagagcaattccaaagaacacgctgttctgcaaatgagcagcctagaaagagagacacggntgatataactgtgcgngaggacttatattatgtacaggtaccattgactacgtcgggacacgggaaccctggcaccgtctaccgtcacgcctacaaccg

SEQ ID NO: 354731 - DNA, 540 bp, Homo sapiens
  misc_feature: GZ8MTXP02IEEMP.21.35.D02.1.454.CMB.2.raw
  modified_base (342)..(342): a, c, t, g, unknown or other
  misc_feature (342)..(342): n is a, c, g, or t
  modified_base (523)..(523): a, c, t, g, unknown or other
  misc_feature (523)..(523): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgtccagcctgggacgtccctgagagtctcctgtgcagcctctggattcagcttcagtgactttgccatgcactgggtcccgccagactccaggcaaggggctaggagtggctggcagttatcgcatttcgatggaagcgatatgtactatgcgactccgtagaggccattcaccanctcagagactaattccaaagaacacgtcttgtttctagacaaatgagcagctagaaaagaagaggacacggactagtaatataactgtgcgacgagtacctttattattatggttcaaggacctattgacttacgtcggggaccaacgggtaaccctggtaaccgtaccgtcctcctaccncgtccctaccgaacccg

SEQ ID NO: 354732 - DNA, 592 bp, Homo sapiens
  misc_feature: GZ8MTXP02IOCRQ.21.35.D02.1.454.CMB.2.raw
  modified_base (247)..(247): a, c, t, g, unknown or other
  misc_feature (247)..(247): n is a, c, g, or t
  modified_base (325)..(325): a, c, t, g, unknown or other
  misc_feature (325)..(325): n is a, c, g, or t
  modified_base (348)..(348): a, c, t, g, unknown or other
  misc_feature (348)..(348): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgngaaggccattcaccatctcaganacaattccaaagaacacgctgtttctgacaaatgagcagacctagaaaagaaggaaggacgacggacttagtaaataataacgtgtagacgacgtaaggtaacctttattaattagttaggttacaacggggtaaccctagtttacgaaccgttaaacggtcgggggtacccgtaacggggtaaccccttcgggtaaccctaccccgttccgtccctacaaccggtcccctacccgaaacccgg

SEQ ID NO: 354733 - DNA, 569 bp, Homo sapiens
  misc_feature: GZ8MTXP02G88ZP.21.35.D02.1.454.CMB.2.raw
  modified_base (290)..(290): a, c, t, g, unknown or other
  misc_feature (290)..(290): n is a, c, g, or t
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
  modified_base (393)..(393): a, c, t, g, unknown or other
  misc_feature (393)..(393): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccgccagacctcgaggcgaaggggctaggagtggctggcagttancgacattcgatggaancgtatatgtactatggcggactcgtaggaacggcattcaccatcncagacactaatccaaagacacgtcttgttctgacaaatgaancagtactagaaagaaggagacacggctagtatataactgtagacgacgagtaccttattacttagtggttacagggtaaccatttacggaccttacggtcggggacccgtaacggggtaacccgttggtaaccgtacccggttcctcccgtacgaccgtccctacccgaaacccgg

SEQ ID NO: 354734 - DNA, 520 bp, Homo sapiens
  misc_feature: GZ8MTXP02J3K7G.21.35.D02.1.454.CMB.2.raw
  modified_base (249)..(249): a, c, t, g, unknown or other
  misc_feature (249)..(249): n is a, c, g, or t
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
  modified_base (374)..(374): a, c, t, g, unknown or other
  misc_feature (374)..(374): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctggggacgtccctgagagtctcctgtgcagcctctggattcagcttcagtgactttgccatgcactgggtccnccagactccaggcaaggggctagagtggctggcagttatcgcattcgatggaagcatangtactatgcggactccgtgaaggaccatcaccatcncagagcaattccaaagacacgctagtttcngacaaatgagcagcctagaaagagagggactacggctgtaatataactgtgcgcgaggtaccttagttattatggtacaggaccattgacttacggcgggaccacggaccctggtaacctacgtctcctacacgtccctaccgacg

SEQ ID NO: 354735 - DNA, 565 bp, Homo sapiens
  misc_feature: GZ8MTXP02GCUXQ.21.35.D02.1.454.CMB.2.raw
  modified_base (287)..(287): a, c, t, g, unknown or other
  misc_feature (287)..(287): n is a, c, g, or t
  modified_base (398)..(398): a, c, t, g, unknown or other
  misc_feature (398)..(398): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagactccaggcaaggggctagagtggctggcagttancgcattcgatggaagcgatatgtactatggcggactccgtagaacggccgattccaccatctaccagagacaattaccaaagaaccacgtcttgtttctagacaaatgaancagacctaagaaacgaaaggaggaacacggacttagtaataagtaacgtagtaggcgacgaggtacctttattaacttagtagttacgaggtaccagttgacgtacgtcggggaccacgggtaaccctggtcctacccgttctcctccgacgtccctaccgaaccgg

SEQ ID NO: 354736 - DNA, 602 bp, Homo sapiens
  misc_feature: GZ8MTXP02FHELN.21.35.D02.1.454.CMB.2.raw
  modified_base (249)..(249): a, c, t, g, unknown or other
  misc_feature (249)..(249): n is a, c, g, or t
  modified_base (292)..(292): a, c, t, g, unknown or other
  misc_feature (292)..(292): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggaggtcgggggaggcgtgttccagcctgggacgtccctgagagtctcctgtgcagcctctggattcagcttcagtgactttgccatgcacgtgggtccnccagactccgaggcaaggggctagagtggctggcagttatcgnattcgatggaagcgatatgtaactagtcggccggactccgtaggaacgggccgacttcaccatcctaccgagacgacaaacttaccaaagaaccacgtcttgtttactagacaaagtgaagcaagtacctaagaaaagaagacggacgacggatagtaataataacgtggtacgcgacgaggtactttagttatacgtaggtacaacgggacctagttacggactaacggtcgggggacccgtaacgggggtaaccccttggggaaccctacccgtccgtaccctacgacgccccctaccgaaaccccgg

SEQ ID NO: 354737 - DNA, 579 bp, Homo sapiens
  misc_feature: GZ8MTXP02HW0V1.21.35.D02.1.454.CMB.2.raw
  modified_base (303)..(303): a, c, t, g, unknown or other
  misc_feature (303)..(303): n is a, c, g, or t
  modified_base (381)..(381): a, c, t, g, unknown or other
  misc_feature (381)..(381): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccgccagacctccgaggcaaggggctagagtggctggcagttatcgcattcgatggaancgatatgtactatgcggactcgtagaagaccgattcaccatctcagagactaattccaaagaaccacgtctagtttcngacaaatgagcagcctagaaagaagaagacacggactagtaatataactgtagacgacgaggtacctttaattattagtaggttacgaagggtacctagtttacgacgttaacggtacggggaccgaacggggtaacccttacgggtaaccgtaacccggttccttacccgtacgaccgtcccttacccgaaacccgg

SEQ ID NO: 354738 - DNA, 634 bp, Homo sapiens
  misc_feature: GZ8MTXP02HT3UX.21.35.D02.1.454.CMB.2.raw
  modified_base (251)..(251): a, c, t, g, unknown or other
  misc_feature (251)..(251): n is a, c, g, or t
  modified_base (293)..(293): a, c, t, g, unknown or other
  misc_feature (293)..(293): n is a, c, g, or t
  modified_base (361)..(361): a, c, t, g, unknown or other
  misc_feature (361)..(361): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgccatgctacgtcgggtccncagacctcgaggcgaaggggctaggagtggctggctagttancgctattcgagtaggaagcgatagtgtactagtcggcgtactcggtaggaacggcctataccaacctntcctaccagaacactaacttacgaaagaacctacgtcttagtttacacaaactaaagtgaacgacgaacgacgtaaagaaaaggaagaacggtacgaacggtacgtagttaaacttaacgtaacgtaggtacggacgtacggtaacggttaacctttaagttaacgttagtacggtacgaacggtactagtttacgacgttacggtacgggaccgaccggtaaccgtcgtaacccgtaccgtcctaccgacgtaccgaccctaccgaaaccgg

SEQ ID NO: 354739 - DNA, 580 bp, Homo sapiens
  misc_feature: GZ8MTXP02HDTBX.21.35.D02.1.454.CMB.2.raw
  modified_base (287)..(287): a, c, t, g, unknown or other
  misc_feature (287)..(287): n is a, c, g, or t
  modified_base (345)..(345): a, c, t, g, unknown or other
  misc_feature (345)..(345): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagacctccaggcaaggggctagagtggctggcagttancgcattcgatggaagcgatatgtactatgcgactcgtgaagggcatcacatctcaganactatacaagacacgtcttgttctgactaaatgagacagactaagaaagaaagacggacgacggtactaagttaataacgttaacgtggtcggaccgacgtaacggttaacctttaattagttaagttggtacgaacgggtacctagttacgtaacgtacgggtcgggtaccgaacgggtacccgtacggtaacccgtaccggtcctaccgtacgaccgtccctaccgaacccgg

SEQ ID NO: 354740 - DNA, 570 bp, Homo sapiens
  misc_feature: GZ8MTXP02GK98E.21.35.D02.1.454.CMB.2.raw
  modified_base (247)..(247): a, c, t, g, unknown or other
  misc_feature (247)..(247): n is a, c, g, or t
  modified_base (301)..(301): a, c, t, g, unknown or other
  misc_feature (301)..(301): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagactccaggcaaggggctagagtggctggcagttatcgcattcgatggaancgatatgtactatgcggactccgtagaacggaccgattccaccatcctaccagagacaattccaaagaacacgtctgtttctgacaaatgagcagacctagaaagaagagacacggactgtaatataaacgtgtgacgacgaggtactttaattacttattggttacacgggtaacctagtttacgaacttacggtcggggtacccgaacggggtaaccccttgggtaaccctacccggttctaccgtccacgtccctaccgaaacccg

SEQ ID NO: 354741 - DNA, 583 bp, Homo sapiens
  misc_feature: GZ8MTXP02G84FR.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagacctccaggcaaggggctagagtggctggcagttatcgcattcgatggaagcgatatgtactatgcgactcgtgaagggcatcacatctcagagacaattaccaaagaacacgcttgtttctgacaaatgagcagactaggaaagaagagacacggactagtaatataacgtgtggacgacgaagtacctttaattagttagtggttacgaacgggtacctagttagaaccgttacggtacgggggtacccgtaaacggggtaaccccgttaggtaacccgtaacccggttacctcccgtaccgaccgtaccccgttacccgaaaccccgg

SEQ ID NO: 354742 - DNA, 573 bp, Homo sapiens
  misc_feature: GZ8MTXP02H2PYD.21.35.D02.1.454.CMB.2.raw
  modified_base (247)..(247): a, c, t, g, unknown or other
  misc_feature (247)..(247): n is a, c, g, or t
  modified_base (351)..(351): a, c, t, g, unknown or other
  misc_feature (351)..(351): n is a, c, g, or t
  modified_base (378)..(378): a, c, t, g, unknown or other
  misc_feature (378)..(378): n is a, c, g, or t
  modified_base (388)..(388): a, c, t, g, unknown or other
  misc_feature (388)..(388): n is a, c, g, or t
  modified_base (415)..(415): a, c, t, g, unknown or other
  misc_feature (415)..(415): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtgaagggccattccaccatctccaganacaaattccaaagaacacgctgtttcngacaaatgancagcctagaaagaagaaggacaacggntagtataataactgtagcgagaacggtacctttagttaattagtaggttacgaaggggtacctagtttagaacttaacggtcgggggaccctaacggggtaacccctgggttaacccgaccgttccgtacccttacgaccgtccctacccgaacccgg

SEQ ID NO: 354743 - DNA, 539 bp, Homo sapiens
  misc_feature: GZ8MTXP02JUWO6.21.35.D02.1.454.CMB.2.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttancgcattcgatggaagcgatatgtactatgcggactccgtagaagggccattcacatctccagagacaattccaaagacacgcttgtttctgacaaatagagcagactagaaagaagaggacgacgactagtatataactgtgacgacgagtacttaattattaaagtgtacgaggtacctagttagactacgtacgggaccgacgggtaacccgtacggtccgaccgtcctccgtcacgtccgtaccaacccg

SEQ ID NO: 354744 - DNA, 505 bp, Homo sapiens
  misc_feature: GZ8MTXP02JH61Y.21.35.D02.1.454.CMB.2.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (352)..(352): a, c, t, g, unknown or other
  misc_feature (352)..(352): n is a, c, g, or t
  modified_base (412)..(412): a, c, t, g, unknown or other
  misc_feature (412)..(412): n is a, c, g, or t
  modified_base (422)..(422): a, c, t, g, unknown or other
  misc_feature (422)..(422): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttancgcattcgatggaagcgatatgtactatgcggactccgtgaacgggccattccaccatctccaganacaattaccaaagaccacgtcttgttctagacaaatgagcagctagaaagagagacacgntgtatatacngtgcgacgagacttatatagtgtcaggtactatgactacgcgggaccacggacctggtccacgtctcctcacgcctccaaccg

SEQ ID NO: 354745 - DNA, 539 bp, Homo sapiens
  misc_feature: GZ8MTXP02JDIIL.21.35.D02.1.454.CMB.2.raw
  modified_base (247)..(247): a, c, t, g, unknown or other
  misc_feature (247)..(247): n is a, c, g, or t
  modified_base (404)..(404): a, c, t, g, unknown or other
  misc_feature (404)..(404): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagactccgaggcaaggggctagagtggctggctagttatcgctagtttcgagtggaagcgatatgtactatgcgactccgtagaacgggccaattccacctatctccaagacgactaattaccaaagaacacgtctttgttctagactaaatgancagactagaaagagagacacgctagtatatactgtagacgagagtacttatatatgtcaggtactagttagactacgcgggaccacgggtaccctggaacctaccgtctacctacgaccgtccctaccgaaccgg

SEQ ID NO: 354746 - DNA, 615 bp, Homo sapiens
  misc_feature: GZ8MTXP02INC7K.21.35.D02.1.454.CMB.2.raw
  modified_base (257)..(257): a, c, t, g, unknown or other
  misc_feature (257)..(257): n is a, c, g, or t
  modified_base (298)..(298): a, c, t, g, unknown or other
  misc_feature (298)..(298): n is a, c, g, or t
  modified_base (321)..(321): a, c, t, g, unknown or other
  misc_feature (321)..(321): n is a, c, g, or t
tcagtcgtcgctcgcacgaccggtgctcgatttagcacacgatagttgggtttgggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggaggtcgggggaggcgtgttccagcctgggacgtccctgagagtctcctgtgcagcctntggattcagcttcagtgactttgccatgcacgtgggtcccnccagctccaggcaaggggctagngtggctggcagttatcgctattccgatggaagcgaatatgtactatggccggtactccggtaggaacgggccgattcgacctatctccagacgacaacttcaaacgacacgtcttcgtttctagtacaaagttggaacgtacgacgtaccgtaaggaaaaacggaaggtaacggaaccgaacggggtaccttaggttaaactaacgttaaaccgtggtacggtaccgaacggtaacggtaaccgtttagttaacgtttaacgttcgggtttaccgaacggggttaaccctaacg

SEQ ID NO: 354747 - DNA, 534 bp, Homo sapiens
  misc_feature: GZ8MTXP02GW3PI.21.35.D02.1.454.CMB.2.raw
  modified_base (250)..(250): a, c, t, g, unknown or other
  misc_feature (250)..(250): n is a, c, g, or t
  modified_base (291)..(291): a, c, t, g, unknown or other
  misc_feature (291)..(291): n is a, c, g, or t
  modified_base (353)..(353): a, c, t, g, unknown or other
  misc_feature (353)..(353): n is a, c, g, or t
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
  modified_base (426)..(426): a, c, t, g, unknown or other
  misc_feature (426)..(426): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtcccnccagacctccaggcaaggggctaggagtggctggcagttancgcattcgatggaagcgatatgtactatgcgactcgtagaacgggccatcaccatctcaganacaattccaaagaacncgtctgttctgacaaatgancagctagaaagagaagacacggctagtaatagtaacnggtagacgacgaacggtacttattattagtcgtacgagggtactagttgactacgtcggggaccacgggaacctcggtcgaccgtctccacgacgccctacgaacccg

SEQ ID NO: 354748 - DNA, 561 bp, Homo sapiens
  misc_feature: GZ8MTXP02ID95D.21.35.D02.1.454.CMB.2.raw
  modified_base (246)..(246): a, c, t, g, unknown or other
  misc_feature (246)..(246): n is a, c, g, or t
  modified_base (369)..(369): a, c, t, g, unknown or other
  misc_feature (369)..(369): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactccgaggcaaggggctagagtggctggcagttatcgcattcgatggaagcgatatgtactatgcgactcgtgaaggcatcacatctcagagacaattccaaagaacacgctgtttcngacaaatgagcagctagaaagagagacacggctagtatataactgtacgcgacgaaggtacctttaattagttaagtcgggttacgaagggtacctagtttacgaacgtacggtacggggaccgtaacggggtaacccctgggtaacctaacccggtcctacccgaccgtacggcccctacccgaaacccgg

SEQ ID NO: 354749 - DNA, 560 bp, Homo sapiens
  misc_feature: GZ8MTXP02GOI79.21.35.D02.1.454.CMB.2.raw
  modified_base (247)..(247): a, c, t, g, unknown or other
  misc_feature (247)..(247): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtgaacgggccatcaccatctcagagacaattccaaagacacgcttgtttctgacaaatgagcagcctagaaagaagagacacggctagtatataactgtagcgcgaggtacctttattattagtggttacgagggtacctagttcgaacttacggtcgggggacccgaacggggtaaccccttgggtaacctacccggttccttacccgtacgaccgtcccctacccgaaacccgg

SEQ ID NO: 354750 - DNA, 517 bp, Homo sapiens
  misc_feature: GZ8MTXP02GXJ9N.21.35.D02.1.454.CMB.2.raw
  modified_base (287)..(287): a, c, t, g, unknown or other
  misc_feature (287)..(287): n is a, c, g, or t
  modified_base (379)..(379): a, c, t, g, unknown or other
  misc_feature (379)..(379): n is a, c, g, or t
  modified_base (412)..(412): a, c, t, g, unknown or other
  misc_feature (412)..(412): n is a, c, g, or t
  modified_base (503)..(503): a, c, t, g, unknown or other
  misc_feature (503)..(503): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagacctccaggcaaggggctagagtggctggcagttancgcattcgatggaagcgatatgtactatgcgactccgtgaacgggccattcacctatctccagacgacaattaccaaagacacgctgtttcngacaaatgagcagctagaaagaagagacacggntagtatatactgtgtagacgagtacttattattagtgtcaggtactagttgactacgacgggaccaacggtacctggaactaccgtctccncgacgcctacaccg

SEQ ID NO: 354751 - DNA, 584 bp, Homo sapiens
  misc_feature: GZ8MTXP02FTIVF.21.35.D02.1.454.CMB.2.raw
  modified_base (288)..(288): a, c, t, g, unknown or other
  misc_feature (288)..(288): n is a, c, g, or t
  modified_base (400)..(400): a, c, t, g, unknown or other
  misc_feature (400)..(400): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagactccaggcaaggggctagagtggctggcagttancgcattcgatggaagcgatatgtactatgcggtactccgtgaacgggctatccaccatcctcaagagacaattcccaaagaaccacgtcttgtttactagactaaaatgaancagacctagaaaaggaagaggacgacggactagtaatataacgtgtagcgacgagtactttattagttatggttacaggacctagttacgaacgttacggtacgggggtacccaacggggtaaccctgggtaaccctaacccggttcctaccgtaccgacggaccccttacccgaaaccccggg

SEQ ID NO: 354752 - DNA, 521 bp, Homo sapiens
  misc_feature: GZ8MTXP02GC3V6.21.35.D02.1.454.CMB.2.raw
  modified_base (341)..(341): a, c, t, g, unknown or other
  misc_feature (341)..(341): n is a, c, g, or t
  modified_base (369)..(369): a, c, t, g, unknown or other
  misc_feature (369)..(369): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcgactccgtgaaggcattcaccatcncagagacaatcaaagacacgctgtttcngacaaatgagcagcctagaaagagagacacggctagtaatataactgtagacgacgagtacttattattagtgttagacgggtactagttagactacgcggggaccacgggaaccctggtccaccgtactcctacacgccctaccgaacccg

SEQ ID NO: 354753 - DNA, 518 bp, Homo sapiens
  misc_feature: GZ8MTXP02IEQZS.21.35.D02.1.454.CMB.2.raw
  modified_base (247)..(247): a, c, t, g, unknown or other
  misc_feature (247)..(247): n is a, c, g, or t
  modified_base (354)..(354): a, c, t, g, unknown or other
  misc_feature (354)..(354): n is a, c, g, or t
  modified_base (382)..(382): a, c, t, g, unknown or other
  misc_feature (382)..(382): n is a, c, g, or t
  modified_base (393)..(393): a, c, t, g, unknown or other
  misc_feature (393)..(393): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctaggagtggctggcagttatcgcattcgatggaagcgatatgtactatgcggactccgtagaagggccgattccaccatctacaganacaattccaaagaacacgcttgtttacngtacaaatgancagctagaaagaagagacacggctagtaatataactgtagcgacgagtacttattattatgtacaggacagttgactacgcgggacacgggtaacctggtccacgtctcctcacgcctacaaccg

SEQ ID NO: 354754 - DNA, 507 bp, Homo sapiens
  misc_feature: GZ8MTXP02HXNVC.21.35.D02.1.454.CMB.2.raw
  modified_base (248)..(248): a, c, t, g, unknown or other
  misc_feature (248)..(248): n is a, c, g, or t
  modified_base (374)..(374): a, c, t, g, unknown or other
  misc_feature (374)..(374): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgacttttgccatgcactgggtccnccagactccaggcaaggggctagagtggctggcagttatcgcattcgatggaagcgatatgtactatgcggactccgtgaagggccattcaccatctcagagcaattccaaagaccagctgtttcngcaaatgagcagcctagaaagaagaggacacggctagtatataactgtgcgcgagacttatatatgtcaggactattgactacgtcgggccacgggaaccctggtccaccgtctcctcacgccctaccaaccg

SEQ ID NO: 354755 - DNA, 579 bp, Homo sapiens
  misc_feature: GZ8MTXP02H1N0O.21.35.D02.1.454.CMB.2.raw
  modified_base (381)..(381): a, c, t, g, unknown or other
  misc_feature (381)..(381): n is a, c, g, or t
  modified_base (390)..(390): a, c, t, g, unknown or other
  misc_feature (390)..(390): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagacctccgaggcgaaggggctagagtggctggcagttatcgctattcgatggaagcgatatgtactatgcgactccgtagaagggcctatccaccatctcagagacaattaccaaagacacgtctgtttcnacaaatgancagactagaaagaagagacgacgactagtataagttaactggtacgacgacgacgtaacctttaattaagttagtacggttacgaacgggtacctagtttacgaacttacgggtacgggtacccgaacgggtaacccgtacggtaacccgaccgttacctcccgtacgacccgtccctacccaacccgg

SEQ ID NO: 354756 - DNA, 580 bp, Homo sapiens
  misc_feature: GZ8MTXP02H7CF9.21.35.D02.1.454.CMB.2.raw
  modified_base (246)..(246): a, c, t, g, unknown or other
  misc_feature (246)..(246): n is a, c, g, or t
  modified_base (286)..(286): a, c, t, g, unknown or other
  misc_feature (286)..(286): n is a, c, g, or t
  modified_base (354)..(354): a, c, t, g, unknown or other
  misc_feature (354)..(354): n is a, c, g, or t
  modified_base (379)..(379): a, c, t, g, unknown or other
  misc_feature (379)..(379): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactccaggcaaggggctaggagtggctggcagttancgcattcgatggaagcgatatgtaactatgcggactccgtagaaacggggccattcaccatctcaganacaattccaaagacacgctgtttcngacaaatgagcagacctagaaaagaagaaggacacggctagtaatataaacgtgtggacgcggaacggtaccttaattattaagttgggttaccaaggggtacctagtttacggaacttacggacgggggaccctaacggggtaaacccctgggtaacccgtaaccgtcctcccgtacacggtccccttaccgaaacccgg

SEQ ID NO: 354757 - DNA, 552 bp, Homo sapiens
  misc_feature: GZ8MTXP02JB6S3.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtccgccagacctccgaggcgaaggggctaggagtggctggctagttatcgctagttcgagtggaagcgatatgtactatgcgactccgtaggaaggcctattccaccatcctacagacactaacttaccgaaagaccacgtcttagtttctagacaaatgagcagacctagaaagagaaggacacggtactagtatataacgtgtcgacgacgaggtaccttattattagtgtacgaggtactagttgacgtacgcgggaccgacggaccgtggtcctaccgtctcctcgaccgtcctaccgaaccg

SEQ ID NO: 354758 - DNA, 513 bp, Homo sapiens
  misc_feature: GZ8MTXP02FWMQJ.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccgattccaccatctccagagcaattccaagaacacgctgttctgacaaatgagcagctagaaagagagacaggctgtatataactgtagcgcgaggtacttattatatggttcagggtacctagttgactacgtacgggccaacggggacctggtcaccgtctacctcacgcctcaaccg

SEQ ID NO: 354759 - DNA, 582 bp, Homo sapiens
  misc_feature: GZ8MTXP02HBBLM.21.35.D02.1.454.CMB.2.raw
  modified_base (247)..(247): a, c, t, g, unknown or other
  misc_feature (247)..(247): n is a, c, g, or t
  modified_base (385)..(385): a, c, t, g, unknown or other
  misc_feature (385)..(385): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtgaagggccattcaccatctccagagacaattccaaagaacacgctgtttctgcaaatgancagctagaaagaagagacgacgactagtaataataacgtgtcgacgacgaacggtacctttaagttatttaagttacggttacgaacgggtaacctagttacgtaacgttacggtacggggacccgaacggggtaaccccgtaggtaaccgtaacccggttccttaccctacgaccggtcccctacccgaaacccgg

SEQ ID NO: 354760 - DNA, 560 bp, Homo sapiens
  misc_feature: GZ8MTXP02F67VD.21.35.D02.1.454.CMB.2.raw
  modified_base (314)..(314): a, c, t, g, unknown or other
  misc_feature (314)..(314): n is a, c, g, or t
  modified_base (324)..(324): a, c, t, g, unknown or other
  misc_feature (324)..(324): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactangcggactcgngaaggcatcaccatctcagagacaatccaaagacacgctgttctagcaaatgagcagccagaaaagaagagacacggactagtaatataactgtaggaccgacggaaggtacctttagtttaattacgtgggtttacaaggggtaacctagtttggaactacggtacgggggacctaacggggaacccttgggtaaccacccgttcctacccgtacgacgtccctacccgaacccg

SEQ ID NO: 354761 - DNA, 529 bp, Homo sapiens
  misc_feature: GZ8MTXP02JLCS3.21.35.D02.1.454.CMB.2.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (429)..(429): a, c, t, g, unknown or other
  misc_feature (429)..(429): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccnccagactccaggcaaggggctagagtggctggcagttancgcattcgatggaagcgatatgtactatgcggactccgtgaaggggccattcaccatcctccagagacaattccaaagacacgctgtttctgacaaatgagcagcctagaaagaagagacacggctgtatataactgtgcgngagacttattatatggttcaggtaccagttgactacggtcggggaccaacggggtaaccctggtaaccaccgttctacccgtcacgccctaccaacccgg

SEQ ID NO: 354762 - DNA, 557 bp, Homo sapiens
  misc_feature: GZ8MTXP02G2800.21.35.D02.1.454.CMB.2.raw
  modified_base (246)..(246): a, c, t, g, unknown or other
  misc_feature (246)..(246): n is a, c, g, or t
  modified_base (282)..(282): a, c, t, g, unknown or other
  misc_feature (282)..(282): n is a, c, g, or t
  modified_base (360)..(360): a, c, t, g, unknown or other
  misc_feature (360)..(360): n is a, c, g, or t
  modified_base (402)..(402): a, c, t, g, unknown or other
  misc_feature (402)..(402): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccncagactcaggcaagggctagagtggctggcagttancgctattcgatggaagcgatatgtactatggcggactccgtagaacggccattcacatctcagacacatccaaagacncgtctgtttcagacaaatgagcagctagaaagagagacacgntagtatataactgtagcgacgagtacttattagttagtagttacgaagggtacctagttacgaccttacggacggggtacccaacgggggtaacccctggggtaaccctacccggttcctacccttacgaaccgtccccgtacccgaaaccccgg

SEQ ID NO: 354763 - DNA, 702 bp, Homo sapiens
  misc_feature: GZ8MTXP02H5O0N.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtcctgagagtctcctgtgcagcctctggattcagcttcagtgactttgccatgcacgtgggtcccgccagacctccgaggcgaaggggctaggagtggcgtggactagttatcgctatttcgagtggaaagcgtaatatagtactagtggcggtactccgtaggaaacggggtcctaacgtccaacctactccgtaccaaggaacgacctaaactttacccaaaaggtaaccacgtctttgttttacacgtaacaaagtagacgacgaacgtaccgtaaaggaaaacgaaaggaacgggaccgaacgggacttagttaaattaacgttaacgtaggtacggacggtacggtaaacggttaaccttttaagttaacgtttaagttacgggtttacgaaacggggttacctaagtttacggaaccgttaacgggtacggggtacccgaacggggtaaccccgttacggtaacccgtacccgtccttacccgtaccgaccgtacccctaaccccgaaacccgg

SEQ ID NO: 354764 - DNA, 545 bp, Homo sapiens
  misc_feature: GZ8MTXP02GNAXE.21.35.D02.1.454.CMB.2.raw
  modified_base (378)..(378): a, c, t, g, unknown or other
  misc_feature (378)..(378): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagactccaggcaaggggctagagtggctggcagttatcgcattcgatggaagcgatatgtactatgcggactccgtgaagggccattcaccatctccagagacaattccaaagaacacgcttgtttcngacaaatgagcagacctagaaaagaacgagggacacgggactagtatataactgtagcgacgtaggtacttagttattagtggttacagggtacctagttgactacgtcggggtaccaacgggtaacccgtggtccgtaccggtctcctacacgccctaccgaaccg

SEQ ID NO: 354765 - DNA, 571 bp, Homo sapiens
  misc_feature: GZ8MTXP02IBPN9.21.35.D02.1.454.CMB.2.raw
  modified_base (247)..(247): a, c, t, g, unknown or other
  misc_feature (247)..(247): n is a, c, g, or t
  modified_base (350)..(350): a, c, t, g, unknown or other
  misc_feature (350)..(350): n is a, c, g, or t
  modified_base (375)..(375): a, c, t, g, unknown or other
  misc_feature (375)..(375): n is a, c, g, or t
  modified_base (385)..(385): a, c, t, g, unknown or other
  misc_feature (385)..(385): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcatttcgatggaagcgatatgtactatgcgactccgtgaagggccattcaccatctccaganacaattcaaagaacacgctgtttcngacaaatgancagacctagaaagaagagacacggactagtatataactgtagcgacgaggtactttattattagtaggttacgaacgggtacctagttagacttaccggtacgggggacccaacggggtaaccccgtagggtaacccgtaacccggttcctccccgtacgaccggtacccttacccgaaaccccgg

SEQ ID NO: 354766 - DNA, 612 bp, Homo sapiens
  misc_feature: GZ8MTXP02GXDFS.21.35.D02.1.454.CMB.2.raw
  modified_base (247)..(247): a, c, t, g, unknown or other
  misc_feature (247)..(247): n is a, c, g, or t
  modified_base (284)..(284): a, c, t, g, unknown or other
  misc_feature (284)..(284): n is a, c, g, or t
  modified_base (384)..(384): a, c, t, g, unknown or other
  misc_feature (384)..(384): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccncagactcaggcaaggggctagagtggctggcagttancgcattcgatggaagcgaatatgtactagtcgcggactccggtagaacgggtccattcacatctcagagactaaattccaaagaacacgtcttgtttacngacaaatgaagcaacgactaagaaaagaaggaggacacggactagtaaataataaacgtgtaggacgacggaaggtacctttaagtttattaagtggtttacgaaacgggtacctaagtttacggaaccttaacggttcgggggacccgtaaacgggggtaacccccttgggttaacccaacccggttaccctcccgtactaacccggtcccctacccgaaaacccgg

SEQ ID NO: 354767 - DNA, 543 bp, Homo sapiens
  misc_feature: GZ8MTXP02H7POC.21.35.D02.1.454.CMB.2.raw
  modified_base (373)..(373): a, c, t, g, unknown or other
  misc_feature (373)..(373): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaagggccattcaccatctcagagacaaattccaaagtaaccacgctntttctgacaaatgagcagacctagaaagaagagacacggctgtaatataaactgtgacgacgaggtacctttattagttaagtggttacgaacgggtaaccagtttcgaactaacgtcggggaccgacgggaaccctggtaaccgacgtctcctcacgccctaccaaccg

SEQ ID NO: 354768 - DNA, 593 bp, Homo sapiens
  misc_feature: GZ8MTXP02H5HRK.21.35.D02.1.454.CMB.2.raw
  modified_base (249)..(249): a, c, t, g, unknown or other
  misc_feature (249)..(249): n is a, c, g, or t
  modified_base (308)..(308): a, c, t, g, unknown or other
  misc_feature (308)..(308): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtcccnccagactccaggcaaggggctagagtggctggcagttatcgcattcgatggaagcgatntgtactatcgcgactccgtgaacggcgatcaccatccgtccaagacgactaacttccaaaagaaccacgctgtttctagacaaatgagcagacctagaaaagaagaggacacggactagtaactaagtaaacgtgtacgacgacgtaaggacctttattaactttagtgggttacaaggggtaacctagttcgaacgttaacggtacggggacccgaacggggtaaacccctgggtaaccctaaccggttccttccgtaccgaccggtaccctaccctaacccgg

SEQ ID NO: 354769 - DNA, 705 bp, Homo sapiens
  misc_feature: GZ8MTXP02I3RCV.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagactccgaggcaaggggctagagtggctggctagttatcgcattcgatggaagcgtaatatgtactagtggcggtactccggtagaaacggggcctacgttccaaccctatcctaccgaagtaacgactaaacttacccgaaaagaaaccgaccgtactttcgttttacctagtaacctaaaagtgaacgaccaacgtacccgtaaggaaaaacggaaacgggaaacgggaaccgaacggtacgttaaggttaaacttaaacgttaaacgtcggttacgggaccgaacgggtaacgggtaacccttttaatttaagttaacgttagggttacgaaggggtaaccctagttacgaaccgttacggtacgggggtacccgtaaacgggggtaaccccttcggggtaaccctacccggttccttacccgtaccgaccgtccccgtacccgaacccgg

SEQ ID NO: 354770 - DNA, 569 bp, Homo sapiens
  misc_feature: GZ8MTXP02G6AYB.21.35.D02.1.454.CMB.2.raw
  modified_base (247)..(247): a, c, t, g, unknown or other
  misc_feature (247)..(247): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtagaaacggggccattccacctatcctaccagacgacaaattccaaagaaccacgtcttgtttcagacaaatgagcagactagaaagaagaggacacggtactagtaataataactgtgcgacgaaggtaccttattattagtggttacgaacgggtacctagttacgactacggtcggggaccaacggggtaaccctggtaaccgtaccggttacctcccgtacgacgccctacccgaacccgg

SEQ ID NO: 354771 - DNA, 638 bp, Homo sapiens
  misc_feature: GZ8MTXP02JKCBE.21.35.D02.1.454.CMB.2.raw
  modified_base (251)..(251): a, c, t, g, unknown or other
  misc_feature (251)..(251): n is a, c, g, or t
  modified_base (294)..(294): a, c, t, g, unknown or other
  misc_feature (294)..(294): n is a, c, g, or t
  modified_base (399)..(399): a, c, t, g, unknown or other
  misc_feature (399)..(399): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggaggtcgggggagcgtgttccagcctgggacgtccctgagagtctcctgtgcagcctctggattcagcttcagtgtactttgccatgctacgtgggtcccnccagacctccgaggcgaaggggctagagtggctggctagttancgcattcgatggaagcgtatagtgtaactagtcgacggtactccggtaggaaacggggcctacttccacctatccacaagacgactaaacttccgaaaagaaccncgtactttgtttacagaacaaagtgaagacaacgtacctaaggaaaaggaacggaggaaccgacggtatagttaaactataaacgtggtacgacggacggtaacggttacctttaagttattagtacggttacgaacgggtacctagttacggaactacggtacggggacccgaacggggtaacccgtcggtaaccctacccgtccgttaccctacgacccgtccctaaccgaacccgg

SEQ ID NO: 354772 - DNA, 519 bp, Homo sapiens
  misc_feature: GZ8MTXP02F261G.21.35.D02.1.454.CMB.2.raw
  modified_base (248)..(248): a, c, t, g, unknown or other
  misc_feature (248)..(248): n is a, c, g, or t
  modified_base (376)..(376): a, c, t, g, unknown or other
  misc_feature (376)..(376): n is a, c, g, or t
  modified_base (503)..(503): a, c, t, g, unknown or other
  misc_feature (503)..(503): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacattttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtgaagggccgattcaccatctccagagacattccaaagacacgctgtttcngcaaatgagcagcctagaaagaaggagaacacggctaggtataataactgtagcgcgaggaccttagttattatggttacaggggtaccagttgactacgtcgggaccagggaacctggtcacgtcncgtcacgcctcaaccg

SEQ ID NO: 354773 - DNA, 545 bp, Homo sapiens
  misc_feature: GZ8MTXP02I8RG4.21.35.D02.1.454.CMB.2.raw
  modified_base (290)..(290): a, c, t, g, unknown or other
  misc_feature (290)..(290): n is a, c, g, or t
  modified_base (529)..(529): a, c, t, g, unknown or other
  misc_feature (529)..(529): n is a, c, g, or t
  modified_base (533)..(533): a, c, t, g, unknown or other
  misc_feature (533)..(533): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccgaggcgaaggggctagagtggctggcagttancgactattcgataggaagcgaatatgtaactagtgcggtactccgtaggaaacgggccattccacctatcctaccagagactaacttaccaaagaaccacgtcttgtttctagacaaatgagcaagcctagaaaagagaaggacacgtctagtatataacgtgtagcgacgagtacttagttattagtgtacaggtacagttcgactagtcgggacacggtaccctgccgacgtctccncacnccctacaacccg

SEQ ID NO: 354774 - DNA, 542 bp, Homo sapiens
  misc_feature: GZ8MTXP02GJYUW.21.35.D02.1.454.CMB.2.raw
  modified_base (247)..(247): a, c, t, g, unknown or other
  misc_feature (247)..(247): n is a, c, g, or t
  modified_base (287)..(287): a, c, t, g, unknown or other
  misc_feature (287)..(287): n is a, c, g, or t
  modified_base (386)..(386): a, c, t, g, unknown or other
  misc_feature (386)..(386): n is a, c, g, or t
  modified_base (414)..(414): a, c, t, g, unknown or other
  misc_feature (414)..(414): n is a, c, g, or t
  modified_base (430)..(430): a, c, t, g, unknown or other
  misc_feature (430)..(430): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactccgaggcaaggggctagagtggctggcagttancgcattcgatggaagcgatatgtactagtgcggtactccgtgaacgggccgattccaccatcctcagagacaattcccaaagaaccacgcttagtttcngacaaatgagcagctagaaagagagacncggatagtatataacngtgacgcgaggtacttattatagtggttacgacgggtactagttgacttacggtcggggaccaacggggtacccctggtccaccgtctacctcgacgtccctaccgaacccg

SEQ ID NO: 354775 - DNA, 562 bp, Homo sapiens
  misc_feature: GZ8MTXP02I2N0A.21.35.D02.1.454.CMB.2.raw
  modified_base (247)..(247): a, c, t, g, unknown or other
  misc_feature (247)..(247): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcatttcgatggaagcgatatgtactatgcgactccgtgaaggccattcacatctccagagacaattcccaaagaacacgctgttctgcaaatgagcagctagaaagagaggacacggctagtaatataactgtagcgtacgaggtaccttattaattagtggttacgaacgggacctagttagtactaacgttcgggggacccaacgggggtaaccccttggggtaacctaccccggttactccccgtacaccggtcccgttaccccaaaccgg

SEQ ID NO: 354776 - DNA, 585 bp, Homo sapiens
  misc_feature: GZ8MTXP02INZ6Q.21.35.D02.1.454.CMB.2.raw
  modified_base (248)..(248): a, c, t, g, unknown or other
  misc_feature (248)..(248): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtgaacgggccattccacatctccagacgacaattccaaagaacacgtntgtttcngacaaatgaagcagcctaagaaagaagaaggacacggctagtaataagtaactgtacggacgacgtaggtaacctttagttaacgttagttcggttacgaacgggtacctagttcgaccgttaacggtcggggacccgtaacggggtaccccttggtaaccctacccggtaccttcccgacgaccggtccctacccgaaacccgg

SEQ ID NO: 354777 - DNA, 682 bp, Homo sapiens
  misc_feature: GZ8MTXP02HSFE6.21.35.D02.1.454.CMB.2.raw
  modified_base (249)..(249): a, c, t, g, unknown or other
  misc_feature (249)..(249): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccgaggcgaaggggctaggagtggctggcagttatcgcatttcgagtggaaagcgaatatgtactagtggcggactccggtgaacgggccattccacctatcctacaagacgaccaaagttaccaaagaaccacgtcttagttttccgagaacctaaaagtcgaacgacgaagtacccgtaaggaaaaacgaaaggaacgggacgaacgggtacttaaggtaaattaaacttaaacgtggtacggaccgtacggtaacggttaacctttaagttacgtttaagttcgggtttaaaccgaacggggtaaccctaagtttacggaaacctttacgggtacggggacccgtaaacgggtaaccccgttacggtaacccgtaacccggttcctacccgtacgacccggtaccccttacccgaaaccccgg

SEQ ID NO: 354778 - DNA, 592 bp, Homo sapiens
  misc_feature: GZ8MTXP02JPIX4.21.35.D02.1.454.CMB.2.raw
  modified_base (247)..(247): a, c, t, g, unknown or other
  misc_feature (247)..(247): n is a, c, g, or t
  modified_base (302)..(302): a, c, t, g, unknown or other
  misc_feature (302)..(302): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagactccaggcaaggggctagagtggctggcagttatcgctattcgatggaancgatatgtactatgacgactccgtagaacgggcctatcgaccatccacagacgactaattaccaaagtaccacgtcttagtttctagacaaaagtgagtcaacgtacctagaaaagaagaaggacacggactagtaataataacgtgtacggcgacgaaggtacctttaattagttaagtcggttacgaagggtacctagttcgaacgtacggtcggggacccgtaacgggtaacccgttggtaacccgtacccggtcctacccgtacgaccgtccctaccgaaacccgg

SEQ ID NO: 354779 - DNA, 569 bp, Homo sapiens
  misc_feature: GZ8MTXP02FYOOI.21.35.D02.1.454.CMB.2.raw
  modified_base (247)..(247): a, c, t, g, unknown or other
  misc_feature (247)..(247): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggtactccgtagaacgggccattccaccatctccagagacaattccaaagacacgtcttgttcagacaaatgagcagacctagaaagaagagacacggactagtatataatgtagcgacgaggtacttattattacgtgtacgacgggtacctagttacgacgtacggtacggggaccgtaacggggtaacccttaggggtaaccctacccggtcctacccgtacgaccgtacccgttaccccgaaaccccgg

SEQ ID NO: 354780 - DNA, 529 bp, Homo sapiens
  misc_feature: GZ8MTXP02H78LZ.21.35.D02.1.454.CMB.2.raw
  modified_base (247)..(247): a, c, t, g, unknown or other
  misc_feature (247)..(247): n is a, c, g, or t
  modified_base (302)..(302): a, c, t, g, unknown or other
  misc_feature (302)..(302): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (377)..(377): a, c, t, g, unknown or other
  misc_feature (377)..(377): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (423)..(423): a, c, t, g, unknown or other
  misc_feature (423)..(423): n is a, c, g, or t
  modified_base (447)..(447): a, c, t, g, unknown or other
  misc_feature (447)..(447): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgaactgggtccnccagactccaggcaaggggctaggagtggctggcagttatcgcattcgatggaancgatatgtactatgcggactccgtgaagggccattcccaccatcncaganacattccaaagaccacgctgtttcngacaaangancagctagaaagaagagacacgactagtatatactgngacgagagtacttattatgtgtanacggactagtcgactacgtgggaccaacgggtaccctggtacctaaccgtctaccgtcgacgccctaccgaacccgaaccgg

SEQ ID NO: 354781 - DNA, 546 bp, Homo sapiens
  misc_feature: GZ8MTXP02INV11.21.35.D02.1.454.CMB.2.raw
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
  modified_base (424)..(424): a, c, t, g, unknown or other
  misc_feature (424)..(424): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagtatcgcattcgatggaancgatatgtactatgcgactccgtgaaggccatcaccatcncaganacaatccaaagaacacgctgtttcngacaaatgagcagctagaaagagagacacggactagtatataacgtgtagacgngagtacttattattagtagtcagggtactagttagacttacggtcggggaccgtaacgggtaacccgtgggtaacccaacccggttccttacccgtacgtaccgtcccctacccaaacccgg

SEQ ID NO: 354782 - DNA, 604 bp, Homo sapiens
  misc_feature: GZ8MTXP02FPETB.21.35.D02.1.454.CMB.2.raw
  modified_base (249)..(249): a, c, t, g, unknown or other
  misc_feature (249)..(249): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcacgtgggtccncagactccgaggcaaggggctagagtggctggcagttatcgcattcgatggaagcgatatgtactatgcggactccggtagaacggccattccgaccatcctaccagacgacaacttaccaaagaaccacgtctagttttccagacaaaagtgaagcacgacctaagaaaagaaggaggaaccgacggtactagtaataataacgtgtaggacgacgtaaggtacctttagtttaagttagtggttacgaagggtacctagttagaactacggtacggggaccgtaaaccgggtacccgtacggtaaccgtacccggttacctcccgtaccgaccgtacccctacccgaacccgg

SEQ ID NO: 354783 - DNA, 546 bp, Homo sapiens
  misc_feature: GZ8MTXP02GTEWC.21.35.D02.1.454.CMB.2.raw
  modified_base (246)..(246): a, c, t, g, unknown or other
  misc_feature (246)..(246): n is a, c, g, or t
  modified_base (286)..(286): a, c, t, g, unknown or other
  misc_feature (286)..(286): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagacctccaggcaaggggctagagtggctggcagttancgcattcgatggaagcgatatgtactatgcgactcgtgaacggcatcacatcncaganacaatccaaagacncgtntgtttcagacaaatgagcagacctagaaaagaagaggacacggtactagtaataataacgtgtacgcgacgaacggtacctttaattattagtggttacgacggtactagttagaacgtacggtacggggaccaacggggtaaccctggtcctacccgtctcctacgacgccctaccgaaccgg

SEQ ID NO: 354784 - DNA, 540 bp, Homo sapiens
  misc_feature: GZ8MTXP02HSRNW.21.35.D02.1.454.CMB.2.raw
  modified_base (376)..(376): a, c, t, g, unknown or other
  misc_feature (376)..(376): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaaggggccgattcaccatctcagagcaattccaaagaacacgctgtttcngacaaatgagcagcctagaaagagaggacacggctgtatataactgtgcgcgaggtaccttattattagtggttacagggtacctagtttcgactacgtcggggaccgacggggaacccgtggtccgacccggtcctccctacgtaccgcccttacccaacccg

SEQ ID NO: 354785 - DNA, 581 bp, Homo sapiens
  misc_feature: GZ8MTXP02GYDIL.21.35.D02.1.454.CMB.2.raw
  modified_base (246)..(246): a, c, t, g, unknown or other
  misc_feature (246)..(246): n is a, c, g, or t
  modified_base (285)..(285): a, c, t, g, unknown or other
  misc_feature (285)..(285): n is a, c, g, or t
  modified_base (427)..(427): a, c, t, g, unknown or other
  misc_feature (427)..(427): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactccaggcaaggggctagagtggctggcagttancgcattcgatggaagcgatatgtactatcggcggtactccgtaggaacggggccattccacctatcctaccagacgactaacttccgaaagaaccacgtcttgtttcagacaaatgagtcagactagaaagagagacacggntagtatataacgtgtacgacgacgagtacctttaatacgttagttcggtacgaagggtacctagttcgaccgttacggtacggggaccaacggggtaaccctggggtaaccaacccggttcttacccgtacgacgtccccgtaaccgaacccgg

SEQ ID NO: 354786 - DNA, 617 bp, Homo sapiens
  misc_feature: GZ8MTXP02IKU90.21.35.D02.1.454.CMB.2.raw
  modified_base (248)..(248): a, c, t, g, unknown or other
  misc_feature (248)..(248): n is a, c, g, or t
  modified_base (290)..(290): a, c, t, g, unknown or other
  misc_feature (290)..(290): n is a, c, g, or t
  modified_base (356)..(356): a, c, t, g, unknown or other
  misc_feature (356)..(356): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (394)..(394): a, c, t, g, unknown or other
  misc_feature (394)..(394): n is a, c, g, or t
  modified_base (420)..(420): a, c, t, g, unknown or other
  misc_feature (420)..(420): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagacctccgaggcaaggggctaggagtggctggcagttancgctagttcgatggaagcgaatatgtactatggcggactcgagaacgggcattcacatctacaganacaattaccaaagacacgtcttntttcngacaaatganacagactagaaagaaggagacacggntagtaataataagtgtacgcgacggtaacggttaacctttaagttaagtttagttacggttacgaacgggtaaccctaagtttcggaaaccgttacgggtaccgggggtacccgtaacggggtaaaccccgttcggggtaaccctaaccccggttcctaccccgtaccgtaccgtaccccgtacccgaaaccccggg

SEQ ID NO: 354787 - DNA, 533 bp, Homo sapiens
  misc_feature: GZ8MTXP02FW69Q.21.35.D02.1.454.CMB.2.raw
  modified_base (463)..(463): a, c, t, g, unknown or other
  misc_feature (463)..(463): n is a, c, g, or t
  modified_base (474)..(474): a, c, t, g, unknown or other
  misc_feature (474)..(474): n is a, c, g, or t
  modified_base (483)..(483): a, c, t, g, unknown or other
  misc_feature (483)..(483): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagactccaggcaaggggctagagtggctggctagttatcgcattcgatgggaagcgatatgtactatcgcggactcgtagaacggcattcaccatcctcagacgacaattaccaaagaccacgtcttgtttcagacaaagtgacgcagacctagaaagagagacgacgatagtatagtaactgtagcgacgagtaccttattattataggtnacggactgtanacgttacgngggaccgacggacctggtaaccgtaccgtctcctcgacgcctacaaccgg

SEQ ID NO: 354788 - DNA, 646 bp, Homo sapiens
  misc_feature: GZ8MTXP02F9K78.21.35.D02.1.454.CMB.2.raw
  modified_base (249)..(249): a, c, t, g, unknown or other
  misc_feature (249)..(249): n is a, c, g, or t
  modified_base (390)..(390): a, c, t, g, unknown or other
  misc_feature (390)..(390): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtcccncagactccgaggcaaggggctaggagtggctggctagttactcgctattcgatggaagcgtatatgtactatcggacggactcgtaggaacgggcctattccactatcctacaagacgtactaacttcccaaagtaacccncgtctttagtttacctagacctaaaagtggaactcaacgtcctaagaaaaggtaagacggacgacggtactacggtaaattaacgtaacgttggtcggacgtacgtaacggttacctttaattacttagttcggttacgacgggtaactagttagaaccgttaaacggtcgggggaccctaaacggggtacccgttacgggtaaccctaacccggttcctaccgttccgaaccggtccccttaacccggaacccgg

SEQ ID NO: 354789 - DNA, 852 bp, Homo sapiens
  misc_feature: GZ8MTXP02IPDKM.21.35.D02.1.454.CMB.2.raw
  modified_base (251)..(251): a, c, t, g, unknown or other
  misc_feature (251)..(251): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggaggtcgggggaggcgtgttccagcctgggacgtccctgagagtctcctgtgcagcctctggattcagtcttcagtgtactttgccatgcacgtgggtccnccagacctccgaggcgaaggggctaggagtggcgtggctagttatcgatagtttcgagtagggaaagcgtaatagttaggtacttagtggaccggtaccgttccgggtaggaaacggggtcccgtaatttccccgaaccctattccgtaccgaaaggtacgtaacctaaactttaccccgaaaaacgaaacccgtaccggtactttcggtttttaccacgaactaaaagttggaaacgtaccaaacggtaacccgttaaaggggaaaaaacggtaaaacggggaacggggaaacccgtaaccgggggttaacttaaaggtttaaaacttaaaacgtttaaaaccgggttgggttaacgggtaccccggaaggggttaaaccggttaaaccgtttttaatttaaaacggttttaaggttcggggtttaaccgaaaacgggggttaacccttaaaaggttttcggtaaaccgttaaaccgggggttcgggggaaaccccggtaaaccgggggttaaacccccgttcgggttaacccgtaaccccggttccctttaccccgttaaccggacccgtttacccccgtaacccggaaaacccccggg

SEQ ID NO: 354790 - DNA, 550 bp, Homo sapiens
  misc_feature: GZ8MTXP02IJXP5.21.35.D02.1.454.CMB.2.raw
  modified_base (247)..(247): a, c, t, g, unknown or other
  misc_feature (247)..(247): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagacctcaggcaaggggctagagtggctggcagttatcgctattcgatggaagcgatatgtactagtggcgactccgtagaacggaccgattccaccatcctacagagactaattaccaaagaaccacgtcttacgtttcagacaaatgagcagactaagaaagaagagacacggactagtaataataactgtagcgacgagtacttattatagtagtacgaggtactagttagactacgcgggaccgaacggtacccgtggtaaccgaccgtcctaccgtacgaccgaccctacgaaccg

SEQ ID NO: 354791 - DNA, 577 bp, Homo sapiens
  misc_feature: GZ8MTXP02H1RFA.21.35.D02.1.454.CMB.2.raw
  modified_base (317)..(317): a, c, t, g, unknown or other
  misc_feature (317)..(317): n is a, c, g, or t
  modified_base (355)..(355): a, c, t, g, unknown or other
  misc_feature (355)..(355): n is a, c, g, or t
  modified_base (386)..(386): a, c, t, g, unknown or other
  misc_feature (386)..(386): n is a, c, g, or t
  modified_base (396)..(396): a, c, t, g, unknown or other
  misc_feature (396)..(396): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccgaggcaaggggctagagtggctggcagttatcgcattcgatggaaagcgatatgtactagngcgactccgtgaacgggcctatccaccatctaccaganactaattaccaaagaaccacgtctgtttacngacaaatgancagctaagaaagagagacacggtactagtaataataacgtgtgacgacgaacggtactttaagttaattacgtaggttacgaacggtacctagttcgtaaacgtacggtacggggaccgaacggggtaaccctggtaaccgaaccgttcctacccgtacgacccaccgttaccaaacccgg

SEQ ID NO: 354792 - DNA, 612 bp, Homo sapiens
  misc_feature: GZ8MTXP02JI1NN.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagactccgaggcaaggggctagagtggctggctagttatcgctattcgatggaagcgtatatgtactatggcggactccgtgaacgggccattcacctatcctaccagaacgactaaacttacccgaaagaaccacgtcttacgttttcagactaaatgaagacagacctaggaaagaaggacggacacggctagtaatataacgtgtagaccgacgtacggtacctttagttattagtggttacaagggtacctagtttacggaccgttacggacgggggtaccctaaacgggggtaacccttcgggtaaccctacccggttcctacccgtacgaaccggtccccctaccgaaaaccccgg

SEQ ID NO: 354793 - DNA, 521 bp, Homo sapiens
  misc_feature: GZ8MTXP02ILN9B.21.35.D02.1.454.CMB.2.raw
  modified_base (249)..(249): a, c, t, g, unknown or other
  misc_feature (249)..(249): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (361)..(361): a, c, t, g, unknown or other
  misc_feature (361)..(361): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
  modified_base (418)..(418): a, c, t, g, unknown or other
  misc_feature (418)..(418): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtcccncagactccaggcaaggggctagagtggctggcagtatcgcattcgatggaagcgatatgtactatgcgactccgtagaggcatcacntctcagncaatccaagaaccacgtntntttcngacaaatgancagctagaaagaagagacagctagtatataactgtgacgngaggtacttattattatggttacagggtaccagtttcgacttacgacggggaccacggaaccctgggtaacctacgtcctccacgacgtccctaccgaacccg

SEQ ID NO: 354794 - DNA, 684 bp, Homo sapiens
  misc_feature: GZ8MTXP02IBT5I.21.35.D02.1.454.CMB.2.raw
  modified_base (249)..(249): a, c, t, g, unknown or other
  misc_feature (249)..(249): n is a, c, g, or t
  modified_base (291)..(291): a, c, t, g, unknown or other
  misc_feature (291)..(291): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccgaggcgaaggggctaggagtggctggcagttancgctattcgatggaagcgaatagtgtaactagtggcggactccggtagaacggggcctacttccaccatctacaagacgacaaacttaccaaagaacctacgtcttagttttaccagtaaccaaaagtcgaacgacgaacgtaccgtaaaggaaaaaggaaacggaacgggaaccgaaacgggtaccgttaagttaaacgttaaagttaaacgtgggttacggaccggacggtaaacggttaaaccttttaagtttaagtttaagttcgggtttacgaaacgggtacctaagtttacggaaccttaacgggttacggggacccgtaacgggggtaacccttcggggtaacctacccggtcctacccgtacgaccgtacccctaccgaacccgg

SEQ ID NO: 354795 - DNA, 570 bp, Homo sapiens
  misc_feature: GZ8MTXP02H5ZR8.21.35.D02.1.454.CMB.2.raw
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcgactccgtgaaggcgatcaccatctcagacncaattcaaagacacgctgtttcngacaaatgagcagcctagaaagagagacgacggctagtataatacgtgtgacgcgaaggtacctttatatttagtggtttacgaacggggtacctagttacggaacttacgggtacggggacccgaacgggggtaaccccttcgggtaacccgtaacccggttcctacccgtacgaccggtcccctacccgaaaccccgg

SEQ ID NO: 354796 - DNA, 593 bp, Homo sapiens
  misc_feature: GZ8MTXP02GKQ96.21.35.D02.1.454.CMB.2.raw
  modified_base (287)..(287): a, c, t, g, unknown or other
  misc_feature (287)..(287): n is a, c, g, or t
  modified_base (367)..(367): a, c, t, g, unknown or other
  misc_feature (367)..(367): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccaggcaaggggctagagtggctggcagttancgcattcgatggaagcgatatgtactatgcggactcgtgaacgggccattcacatctacagagacaattccaaagaaccncgtcttgtttcctagacaaaagtgagcaagacctaggaaaagaaggaaggacaacggactagtaatataactggtagcgacgaggtacctttattaacttagtagtttacgaagggtacctaagtttacgacgttaacggtacggggacccgtaacggggtaaaccccgttgggtaaccctacccgttaccgttccctacgaccgtaccccgtacccgaaacccgg

SEQ ID NO: 354797 - DNA, 564 bp, Homo sapiens
  misc_feature: GZ8MTXP02GHS6X.21.35.D02.1.454.CMB.2.raw
  modified_base (247)..(247): a, c, t, g, unknown or other
  misc_feature (247)..(247): n is a, c, g, or t
  modified_base (323)..(323): a, c, t, g, unknown or other
  misc_feature (323)..(323): n is a, c, g, or t
  modified_base (344)..(344): a, c, t, g, unknown or other
  misc_feature (344)..(344): n is a, c, g, or t
  modified_base (381)..(381): a, c, t, g, unknown or other
  misc_feature (381)..(381): n is a, c, g, or t
  modified_base (417)..(417): a, c, t, g, unknown or other
  misc_feature (417)..(417): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccncagactccaggcaaggggctagagtggctggcagttatcgcattcgatggaagcgaatatgtactatgcgactcgngaaggcatcaccatctcaganacaattccaaagaacacgctgtttactgacaaatgancagcctagaaagagagacacggactagtaatataangtacgacgacgagtacctttaatattagtacggttcaagggtacctaagtttagaacgtaacggtcggggaccgtaaacggggaaccccttagggtaaccctaacccggttcctacccctccgacggaccccctaccgaaaacccgg

SEQ ID NO: 354798 - DNA, 619 bp, Homo sapiens
  misc_feature: GZ8MTXP02H9ZDI.21.35.D02.1.454.CMB.2.raw
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
  modified_base (369)..(369): a, c, t, g, unknown or other
  misc_feature (369)..(369): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggaggtcggggggaggcgtgttccagcctgggacgtccctgagagtctcctgtgcagcctctggattcagcttcagtgactttgccatgcacgtgggtccnccagactccgaggcgaaggggctaggagtggctggcagttancgctattcgagtggaagcgatatgtactagtggacggactccgtaggaacgggcctataccacctatcctacgaganacctaattaccaaagaaccacgtcttgtttcagacaaatgaagcagaccgtaagaaaaggaagaacgggacaacgggtacttagtaaacttaagttaaacgtggtacggacgacggtaaacggttaacctttaagtttaagttagttggttacgaacggtacctagtttacgaacgtacgggtcggggaaccgtaccgggtaaccctggaaccgtacccgtacctccacgaccgccctacccgaacccgg

SEQ ID NO: 354799 - DNA, 518 bp, Homo sapiens
  misc_feature: GZ8MTXP02F5IIC.21.35.D02.1.454.CMB.2.raw
  modified_base (288)..(288): a, c, t, g, unknown or other
  misc_feature (288)..(288): n is a, c, g, or t
  modified_base (326)..(326): a, c, t, g, unknown or other
  misc_feature (326)..(326): n is a, c, g, or t
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
  modified_base (418)..(418): a, c, t, g, unknown or other
  misc_feature (418)..(418): n is a, c, g, or t
  modified_base (437)..(437): a, c, t, g, unknown or other
  misc_feature (437)..(437): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagactccgaggcaaggggctagagtggctggcagttancgcattcgatggaagcgatatgtactatgcgactccgngaacggcatcaccatcctcagagacaattccaaagaccagctgtttcngacaaatgancagctagaaagagagacacgactagtaatatacngtgcgacgagacttatatntagtacaggtacagttagactacgtcgggaccgacgggaaccctggtaaccgaccgtcctcctacacgccctacaaacccg

SEQ ID NO: 354800 - DNA, 598 bp, Homo sapiens
  misc_feature: GZ8MTXP02IVN36.21.35.D02.1.454.CMB.2.raw
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
  modified_base (343)..(343): a, c, t, g, unknown or other
  misc_feature (343)..(343): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccncagactccaggcaaggggctagagtggctggcagttancgcattcgatggaagcgatatgtactatgcgactccgtgaaggcatcacatctcagancaattccaaagaacacgctgttctgacaaatgagcagactagaaagaagagacacggactagtaataataacgtgtaggcgacggaggtaacctttaagttaacttaagttacgggttacgaacggggtaaccctaagtttacggaaacttaacggtacgggggacccgtaaacgggggtaaccccttaggggtaacccgtaacccggttcccgttacccgtaccgtaaccggtccccgtacccaaaaccccggg

SEQ ID NO: 354801 - DNA, 567 bp, Homo sapiens
  misc_feature: GZ8MTXP02JO3E4.21.35.D02.1.454.CMB.2.raw
  modified_base (247)..(247): a, c, t, g, unknown or other
  misc_feature (247)..(247): n is a, c, g, or t
  modified_base (386)..(386): a, c, t, g, unknown or other
  misc_feature (386)..(386): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccgaggcaaggggctagagtggctggcagttatcgctattcgatggaagcgatatgtactatgcggactccgtagaaacgggccattccacctatctcaagagacaaattccaaagaaccacgcttgtttcngacaaatgagcagctagaaagaagagacacggctagtaatataacgtgtagacgacgacggtaccttattattagtaggttcaagggtacctagttagacgtacggtacggggaccaacgggtaacccgtggtaaccgtaacccggtacctcccgtacgaccgtccctacccgaaacccgg

SEQ ID NO: 354802 - DNA, 548 bp, Homo sapiens
  misc_feature: GZ8MTXP02IF0TZ.21.35.D02.1.454.CMB.2.raw
  modified_base (404)..(404): a, c, t, g, unknown or other
  misc_feature (404)..(404): n is a, c, g, or t
  modified_base (477)..(477): a, c, t, g, unknown or other
  misc_feature (477)..(477): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactcccaggcaaggggctagagtggctggcagttatcgcattcgatggaagcgatatgtactagtgcggactccgtagaagggccgattcaccatctaccaagacgactaaattcccaaagaaaccacgctggtttactgacaaaatgaacgnaagcctaagaaaagaagaacggaacaggacttagtaatataactgtagacgacgagtaccttatattatggtnacgggtacattgaacttacgcgggaccacgggaacctggtaacaccgtctacctcacgtccctacgaaccg

SEQ ID NO: 354803 - DNA, 609 bp, Homo sapiens
  misc_feature: GZ8MTXP02JA7U0.21.35.D02.1.454.CMB.2.raw
  modified_base (518)..(518): a, c, t, g, unknown or other
  misc_feature (518)..(518): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgcctatgcacgtgggtccgccagacctccgaggcgaaggggctagagtggctggctagttatcgactagtttcgagtggaagcgtaatatgtaactagtggaccggtactccgtaggaaacgggtcctacttccaccgtatcctaccgaagacgactaaacttaccgaaagaaccacgtcttgtttaccagtaactaaatgacgacacgacctaggaaaagaaggaaggaaccgacggtactagttaaatataacgtgtagcgacgagtaccttattatagtagtnacggtactagtacgactacggtcgggacgtaacggtacccgtggtaaccctaccggttcctaccgtactaaccgcccgtacgaaaccccgg

SEQ ID NO: 354804 - DNA, 698 bp, Homo sapiens
  misc_feature: GZ8MTXP02IPNKI.21.35.D02.1.454.CMB.2.raw
  modified_base (248)..(248): a, c, t, g, unknown or other
  misc_feature (248)..(248): n is a, c, g, or t
  modified_base (293)..(293): a, c, t, g, unknown or other
  misc_feature (293)..(293): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtgggtccnccagacctccgaggcgaaggggctaggagtggctggactagttancgctagtttcgagtggaagcgtaatagtgtactagtggaccggtactccggaggaaacgggcctatccacctatcctaccaagacacctaaacttacccgaaagaaccctccgtactttcgtttacagtaacaaagtgaacgaccgtaacgacgtaaaggaaaagaacggaacggaacgacggacttaagttaagtaaacgttacgtcggtacggaccggtacgtaacggttaactttaagtttaacgtttagttacggggttacgtaacggggtaaccttagttacggtaaaccgttacgggtacggggtaacccgtaaccggggttaacccgttcgggtaacccgtaaccccggttaccgttcccgtaacgtaccccgtaccccgtaacccgaaacccccggg

SEQ ID NO: 354805 - DNA, 623 bp, Homo sapiens
  misc_feature: GZ8MTXP02GDSM2.21.35.D02.1.454.CMB.2.raw
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
  modified_base (345)..(345): a, c, t, g, unknown or other
  misc_feature (345)..(345): n is a, c, g, or t
  modified_base (493)..(493): a, c, t, g, unknown or other
  misc_feature (493)..(493): n is a, c, g, or t
tcagtcgtcgctcgcacgaccggtgctcgatttagcacacgatagttgggtttggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggaggcgtgttccagcctgggacgtccctgagagtctcctgtgcagcctctggattcagcttcagtgactttgccatgcactgggtcccnccagactccgaggcgaaggggctaggngtcggcgtggctagttacncgactagttccgagtacgggaagcgtaatattggtacctagtcggaccgggaaccgttcccgggtaaggaacggggtcccgtacttaccgaaccctatcctacccaaggaacaacctaacttaccaaagaaccacgtcttcgtttacngtaacaaagtgacgcgagacctaaggaaaagaggaggacgaacggtactagtaataacgtaactggtacgacgtacggtaacgtaacctttaagttaacgtttagtcggttacgaacgggtaccttaagg

SEQ ID NO: 354806 - DNA, 718 bp, Homo sapiens
  misc_feature: GZ8MTXP02HWMYU.21.35.D02.1.454.CMB.2.raw
  modified_base (247)..(247): a, c, t, g, unknown or other
  misc_feature (247)..(247): n is a, c, g, or t
  modified_base (288)..(288): a, c, t, g, unknown or other
  misc_feature (288)..(288): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcgaaggggctagagtggctggcagttacncgctattcgagtggaagcgaatatagtactagtggacggactccggtaggaacgggcctacttaccaacctatcctacgaagaacgactaaacttaccaaaacgaaccacgtcttgtttaccacgaactaaaagtcgaacgaccgaacgtaccgtaaaggaaaaacggaaacgggaaacgggtaaccgaaccgggtacttaaaggttaaattaaacgttaaacgttggtacgggaccggtaacgggtaaacggttaaaccttttaaagtttaacgtttaaggttacgggttaacgaaacgggtaaccgttaagtttacggtaacgttaaccgggtacgggggaaacccgtaaaccggggtaaccccgttcgggtaacccgtaacccggttcccttacccgtaccgaccgtaccccgtaacccgaacccgg

SEQ ID NO: 354807 - DNA, 641 bp, Homo sapiens
  misc_feature: GZ8MTXP02HXTYM.21.35.D02.1.454.CMB.2.raw
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagactccaggcaaggggctagagtggctggcagttancgnattcgatggaagcgatatgtactatggcgactccgtagaagggccattccaccatctcagacgacaattccaaagaccacgcttgtttactgactaaagtgacgacacgacctaaggaaaagaaggaacggacgacgggtacttaggtaattaaacgttaaacgttggtacgaccggacggtaacggttaacctttaagtttaactttaaggttacgggttacgtaaacggggtaccctaagtttacggaacttaacgggttacggggacccgtaaacgggggtaaccccttcgggtaacccgtaacccggttcctacccgtccaaccggtccccttaacccgaaacccgg

SEQ ID NO: 354808 - DNA, 705 bp, Homo sapiens
  misc_feature: GZ8MTXP02G1M9V.21.35.D02.1.454.CMB.2.raw
  modified_base (303)..(303): a, c, t, g, unknown or other
  misc_feature (303)..(303): n is a, c, g, or t
  modified_base (350)..(350): a, c, t, g, unknown or other
  misc_feature (350)..(350): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacgtggtggaggtcggggggagcgtgttccagcctgggacgtcctgagagtctctgtgcagcctgtggattcagtcttcagtgtactttgccatcgcacgtcgggtccncagacctcgaggacgaaggggctaggaggtggcgtggactagttacncgactagttaccgagtggaaagcgtaattagtagtactagtcggtaccggaccgttccgggtaggaaacgggtccgtaaactcccaaaccctactaccgtaccgaaaggaaacaaaccgtaaacttaacccgaaaacgaaaccgtaaccgttccgtttacgtttacgtaccgtaaacgtaaaagtcggaaacgaccaacggtaacccgtaaaggaaaaaggaaacggaacgggtaaccgaaccgggtacttaaggttaaaactaaacgtaaaccggttggtaccggaccggtaacggtaacggtaaactttaagttaacgtttagggtacggttaacggacggtaaccgttaagg

SEQ ID NO: 354809 - DNA, 605 bp, Homo sapiens
  misc_feature: GZ8MTXP02GYFJ3.21.35.D02.1.454.CMB.2.raw
  modified_base (247)..(247): a, c, t, g, unknown or other
  misc_feature (247)..(247): n is a, c, g, or t
  modified_base (290)..(290): a, c, t, g, unknown or other
  misc_feature (290)..(290): n is a, c, g, or t
  modified_base (344)..(344): a, c, t, g, unknown or other
  misc_feature (344)..(344): n is a, c, g, or t
  modified_base (347)..(347): a, c, t, g, unknown or other
  misc_feature (347)..(347): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagacctccgaggcgaaggggctaggagtggctggcagttancgctattcgatggaagcgatatgtactagtgcggactcgtagaacggcatcacntcncagacactaattaccaaagaaccacgtcttgtttacagacaaagtgaagcaacgacctaaggaaaacgaagaacggacacggactagtaaataactaacgtgtacgacgacggtaacgtactttaagttaagttagtacggttacgacgggtactagttacgtaccgttacggtacggggtaccgaaccggggtaacccgttcgggtaacccgtaccggttcctacccgtacgaccgtaccccgtaccgaaaccccgg

SEQ ID NO: 354810 - DNA, 689 bp, Homo sapiens
  misc_feature: GZ8MTXP02I63ZL.21.35.D02.1.454.CMB.2.raw
  modified_base (297)..(297): a, c, t, g, unknown or other
  misc_feature (297)..(297): n is a, c, g, or t
  modified_base (339)..(339): a, c, t, g, unknown or other
  misc_feature (339)..(339): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggagcgtgtccagcctgggactccctgagagtctcctgtgcagcctctggattcagcttcagtgactttgccatgcacgtgggtccnccagacctccgaggcaaggggctagagtggctggctagttancgactattccgagtggaagcgtatatgtactatcggaccggtactccgggtaggaaacggggtcccgtaagttcccaacccgtactccgtacccgaaagtaacgtaaccctaaaattaccccgaaaagtaaccgaccgtacgttcggttttaccaggtaacctaaaagtggaaacgccgtaacggacccgttaaagggaaaaaggaacgggaaacgggtaaccgaaacccggggtacttaagggttaaattaacgttaaaccggttggtaccggaccggtacggaaacggttaaccttttaaagttaacgtttagtacggggtttaccgaacggggttaacccttaaggg

SEQ ID NO: 354811 - DNA, 560 bp, Homo sapiens
  misc_feature: GZ8MTXP02JSIVG.21.35.D02.1.454.CMB.2.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (353)..(353): a, c, t, g, unknown or other
  misc_feature (353)..(353): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactcgaggcaaggggctagagtggctggcagttancgcattcgatggaagcgaatatgtactagtgcggactcgtgaacggccgattccaccatcctcaganactaattaccaaagaccacgtcttgtttactagacaaatgagcagacctaagaaagaagaggacacggtactagtaatactaacgtggtagacgacgacggtacctttatattagtgttacgacggtacctagttacgacttacggtacggggaccacggggtaccctggcctaccgtcctacctacgaccgtccctaccaacccgg

SEQ ID NO: 354812 - DNA, 877 bp, Homo sapiens
  misc_feature: GZ8MTXP02IN2GP.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcggggggaggcgtgttccagcctgggacgtccctgagagtctcctgtgcagcctctggattcagtcttcagtgactttgccatgcacgtgggtcccgccagacctccgaggcgaaaggggctaggagtggctggctagttatcgctatttcgagtggaagcgtaatatgtaactagtcggccggtaaccttccggtaggaaacccggggtccgtaactttcccgaaccctaattcccgttacccgaacggaacgaccgttaaaactttaccccgaaaacggaaaacccctccgggtaccttttacggtttttaccgtaacggtaaacctaaaaagtttacggaaacgtacccgtaaaccgggtaccccgttaaaaggggaaaaaacgggaaaaggggaaaaccgggggtaaacccgtaaaccggggtaccgtttaaagggttaaactttaaaacggtttaaaacccgttggggtttacgggaaccccggtaccggggtaaacgggtttaacccctttttaaagttttaaacgtttaacggtttacggggtttaaccgtaaacgggggttaaaccttaggttttaaccggtaaacccgtttaaaccggggtaccggggggacccgtaaaccgggggtaaccccggttacgggttaaccccgtaacccggttcccttaccccggtaccgtacccggtacccccttaacccgtaaacccccggg

SEQ ID NO: 354813 - DNA, 592 bp, Homo sapiens
  misc_feature: GZ8MTXP02H4DC2.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtcccnccagacctccgaggcgaaggggctaggagtggctggcagttatcgcattcgatggaagcgatatgtactatgcgatccgtagaacggggcctattcaaccatctacagacgactaaattccaaagtaaccacgctgtttcagtacaaatgagcagcctagaaagaagaggtacacggtatagtaatataaacgtgtacggaccgaggaacggtaacctttaagtagtttaagtggtttaccgaagggtacctagtttacgaactaacggtcggggaccctaacggggtaaccctggtaaccgacccggttacctccgtacgaccgtaccctacccgaaacccgg

SEQ ID NO: 354814 - DNA, 529 bp, Homo sapiens
  misc_feature: GZ8MTXP02GR8JU.21.35.D02.1.454.CMB.2.raw
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggtagggcgtagagtggctggcagttatcgcattcgatggaagcgatatgtactatgcggactccgtgaaggccgtatccaccatctccagagacattccaaagaacacgctgtttctgacaaatgagcagcctagaaaagagaggacacggntagtataataactgngacgngaagtactttatattaatggttacagggacctattcgatacgtggggcctaacgggacccttggtacaaccgtctccgtcacgccctaccaccgaacgg

SEQ ID NO: 354815 - DNA, 539 bp, Homo sapiens
  misc_feature: GZ8MTXP02GXM2Q.21.35.D02.1.454.CMB.2.raw
  modified_base (255)..(255): a, c, t, g, unknown or other
  misc_feature (255)..(255): n is a, c, g, or t
  modified_base (298)..(298): a, c, t, g, unknown or other
  misc_feature (298)..(298): n is a, c, g, or t
  modified_base (374)..(374): a, c, t, g, unknown or other
  misc_feature (374)..(374): n is a, c, g, or t
  modified_base (407)..(407): a, c, t, g, unknown or other
  misc_feature (407)..(407): n is a, c, g, or t
  modified_base (437)..(437): a, c, t, g, unknown or other
  misc_feature (437)..(437): n is a, c, g, or t
tcagtcgtcgctcgcacgaccggtgctcgatttagcacacgatagttgggtttgggagaggagcccagcactggaagtcgccggtgtttccattcggtgatcagcactgaacacagaggactcaccatggagtttgggctgacctgggttttcctcgttgctcttttaagaggtgtccactgtcaggtccactggtggagtcgggggaggcgtgttccagcctgggacgtccctgagagtctcctgtgcagcctntggattcagtcttcagtgactttgccatgcacgtcgggtcccnccagacctccgaggcgaaggggctaggagtggctggctagttatcgctattccgatggaaagcgatatggtactanggccggactccggtagaacggccgatcacatcncagagacataccaagacacgctgttctganaatagagacagacctagaaagaagagacgacgctagtatactacgtagtcgacgacgaggtaacctttaagttaacttagtaggggttactacggacttaag

SEQ ID NO: 354816 - DNA, 606 bp, Homo sapiens
  misc_feature: GZ8MTXP02IDIQF.21.35.D02.1.454.CMB.2.raw
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
  modified_base (355)..(355): a, c, t, g, unknown or other
  misc_feature (355)..(355): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccgaggcaaggggctagagtggctggcagttancgcattcgatggaagcgatatgtactagtgcgactccgtaggaacgggccattccaccatctcaganactaattaccaaagaacncgtctntttcagtacaaatgagacagctagaaagaagagacacggactagtaataattaacgtgtacgcggacggtaacggttaacctttagtttaagtttagtagggttacgaacgggtaacctagtttacggaactttaacgggcggggacccgtaacgggggtaaccccttcggggtaaccctacccggttccttcccgaccgtaccgtaccccttacccgaaaccccgg

SEQ ID NO: 354817 - DNA, 563 bp, Homo sapiens
  misc_feature: GZ8MTXP02JMZDO.21.35.D02.1.454.CMB.2.raw
  modified_base (247)..(247): a, c, t, g, unknown or other
  misc_feature (247)..(247): n is a, c, g, or t
  modified_base (287)..(287): a, c, t, g, unknown or other
  misc_feature (287)..(287): n is a, c, g, or t
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtcccnccagactccgaggcaaggggctagagtggctggcagttancgcagttcgatggaagcgaatatgtactagtggcgactccgtgaacggccattcaccntctcaganactatcaaagacacgcttgtttcngacaaatgancagactagaaagagagacacggactagtaatataacgtgtacgacgacgtacggtacttagttattagtgttacgaacgggtacctagttacgaaccttacggtacggggaccgacgggtaaccctcgggtaaccacccggttcctcccgtaccgacgtacccgtacccaacccgg

SEQ ID NO: 354818 - DNA, 539 bp, Homo sapiens
  misc_feature: GZ8MTXP02HF50T.21.35.D02.1.454.CMB.2.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagactccaggcaaggggctagagtggctggcagttancgcattcgatggaagcgatatgtactatgcgactccgtgaaggccatcaccatctcaganacaattcaaagacncgctgtttcngacaaatgagcagcctagaaagaagaggacgacggactagtaatagttaactgtgcgacgaggtaccttattattatggttacgacgggtactagttagacgtaacgtcggggaccgaacggggaccctgggaaccctacggtactccgtacacgccctaccgaacccg

SEQ ID NO: 354819 - DNA, 625 bp, Homo sapiens
  misc_feature: GZ8MTXP02GIKTJ.21.35.D02.1.454.CMB.2.raw
  modified_base (393)..(393): a, c, t, g, unknown or other
  misc_feature (393)..(393): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtcccgccagactcccaggcaaggggctagagtggctggcagttatcgcatttcgatggaaagcgatatgtactatgcggactccggtgaaacggggccgattccaccatcctccagacgacaaacttccaaagaaccacgctagtttcngacaaatgagcagacctagaaaagaagagaacacggactagtaactaataaactggtacgcgacgtaacgggtaacctttaatttaagtttaagttgggttacgaaacgggtaccctaagtttcggaaacctttacgggacgggggtaccccgaacgggggtaaacccccgttggggtaaccctaaccccggttcttacccctacgaccggtccccttacccgaaaccccgg

SEQ ID NO: 354820 - DNA, 732 bp, Homo sapiens
  misc_feature: GZ8MTXP02GWN1K.21.35.D02.1.454.CMB.2.raw
  modified_base (260)..(260): a, c, t, g, unknown or other
  misc_feature (260)..(260): n is a, c, g, or t
  modified_base (310)..(310): a, c, t, g, unknown or other
  misc_feature (310)..(310): n is a, c, g, or t
tcagtcgtcgctcgcacgaccggtgctcgatttagcacacgatagttggggtttcgggggaaagaggaacgactggacggtcctcgccacaggtggtgctgggcacggtgggcactcgacacaacatttgccgtctccactgtcaggtccacctggtggagtcgggggagcgtgttccagcctgggacgtcctgaggagtctcctgtgcagcctcgtggattcagtcttcagtcgtactttgccatgctacgtgggtccnccagacctaccgaaggcgaaggggctaggagtgggctggactaggttacncgactagtttcgagtgggaagcgtaatgtgtactagtggcggtactcggtaggaacggccacttaccactatccgtacgaagaacgactaaacttaccgaaaacgtaaacccgaccggtaccttacgttttaccgaacgaacctaaaagttcgaaacgccgtaaacggtaacccgtaaagggaaaacggaaacggaacgggaaccgacggggtaacttaggttaaattaacgttaaacgtcggtacgggaccggtacggtaaacggttaacctttaagttaacgtttaggttacgggtttacgtaacgggttacctaggtttacgtaaaccgttacgggtacggggtaccgtaaacggggtaacccgttggtaaccctaccggttccgtaccgtacgaccgtccccgtaacccgaacccggg

SEQ ID NO: 354821 - DNA, 682 bp, Homo sapiens
  misc_feature: GZ8MTXP02G3E9B.21.35.D02.1.454.CMB.2.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagactcgaggcaaggggctagagtggctggcagttancgctattcgatggaaagcgaatatgtactatcggcggtactccggtaggaacggggcctagttcacctatcctaccaagacgtactaaacttacccaaaaggaacctacgtactttgtttacctagacctaaaagtgaacgacaagacctaaggaaaagaaacggaacggaaccgacggtactagttaaataacttaacgtgtacggaccgtacggtaacgttaaccgtttaattaacgtttagtacgggtttacgaacgggtacctagtttacggtaaccgttaacgggtaccgggggtaacccgtaacggggtaaaccccgtttacggtaacccgtaaccccggttccgttacccgtaccgtaaccgtcccccgttaacccgtaaaccccggg

SEQ ID NO: 354822 - DNA, 721 bp, Homo sapiens
  misc_feature: GZ8MTXP02GRE9J.21.35.D02.1.454.CMB.2.raw
  modified_base (313)..(313): a, c, t, g, unknown or other
  misc_feature (313)..(313): n is a, c, g, or t
  modified_base (363)..(363): a, c, t, g, unknown or other
  misc_feature (363)..(363): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggaggtcgggggaggcgtgttccagccgtgggaccgtccctgagagtctcctgtgcagcctcgtggattcagtcttcgagtcgtactttgcctatcgctacgtcgggtcccnccagacctccgagggacgaaggggctaggaggtcggcgtggctagttacncggactagttaccgagtaggaagtcgtaatagtagtactagtcggaccggtacctccgggtaggaaacggggtcccgtacttaccacccgtactcccgtaccgaacgaacgtaaacccgtaaacttaacccgaaaacgaaacccgtaaccggttaccgtttacgttttacgtacggtaaaccgtaaaagtacggaacgaccgaacggtaccgtaaaggaaaacggaaaggaacggaaccgtaacggtacgttagtaaacttaaacgtaaacgttacggtacggtaccggtaacggtaacggttaaccgtttaagtttaacgtttaggttacggttaacggaacggttaacccgttaag

SEQ ID NO: 354823 - DNA, 657 bp, Homo sapiens
  misc_feature: GZ8MTXP02HVY9O.21.35.D02.1.454.CMB.2.raw
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (376)..(376): a, c, t, g, unknown or other
  misc_feature (376)..(376): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgtccagcctgggacgtccctgagagtctcctgtgcagcctctggattcagctttcagtgtactttgccatgcacgtgggtccgcagacctccaggcaaggggctagagtggctggcagttanccgntagttcgagtggaagcgatatgtactagtcgcggtactccggtaggaaacggggtcctattaccaccctatccgtaccaaggaanactaaacttaccaaagaaccacgtctgttttacagaaacaaagtgacgacaagtccgtaggaaaaagacggaacggaccgaacggacttagtaaataacgttaacgtggtacggaccgtaggaaacggttacctttaagttagttaaggttcggtacgaacgggttaacctaatttacggaaccttacgggtacgggaacccggtaaccggtaaaccccggtcggtaaacccgtacccggtcccttcccgtaccgtaccgtacccctacccgaaaacccgg

SEQ ID NO: 354824 - DNA, 676 bp, Homo sapiens
  misc_feature: GZ8MTXP02G8FDJ.21.35.D02.1.454.CMB.2.raw
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactccaggcaaggggctagagtggctggcagtancgcattcgatggaagcaatatgtaactagtgcggtactccggtagaaacgggccgattccgacctatcctaccaagagacctaataccaaagtaaccacgtcttgttttaccagacaaaagtcgaacgacaacgtacctaaggaaaaggaaggaacggaaccgaaacgggccttaaggttaaactaaagttaaaaccgtgggttacggaccggtaacggtaaacgggttaacccttttaaatttaaagtttaacgttggggtttaacaaacgggggtaacccttaagtttacggaaccgttaaacggtcgggggaacctaaacggggtaaccccgttaggttaaccgaacccgttcctaccccgtagaacccgtccctaccgaaaccccgg

SEQ ID NO: 354825 - DNA, 541 bp, Homo sapiens
  misc_feature: GZ8MTXP02IWCJK.21.35.D02.1.454.CMB.2.raw
  modified_base (295)..(295): a, c, t, g, unknown or other
  misc_feature (295)..(295): n is a, c, g, or t
  modified_base (319)..(319): a, c, t, g, unknown or other
  misc_feature (319)..(319): n is a, c, g, or t
  modified_base (334)..(334): a, c, t, g, unknown or other
  misc_feature (334)..(334): n is a, c, g, or t
  modified_base (337)..(337): a, c, t, g, unknown or other
  misc_feature (337)..(337): n is a, c, g, or t
  modified_base (350)..(350): a, c, t, g, unknown or other
  misc_feature (350)..(350): n is a, c, g, or t
  modified_base (500)..(500): a, c, t, g, unknown or other
  misc_feature (500)..(500): n is a, c, g, or t
tcagtcgtcgctcgcacgaccggtgctcgatttagcacacgatagttgggtttgggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggagcgtgttccagcctgggacgtccctgagagtctcctgtgcagcctctggattcagcttcagtgactttgccatgcactgggtcccnccagactccaggcaaggggctagngtggctggcagttancgnattccgatggaancgatatgtactatggccggtactccggagaacggggcccgattccaccctatcctccaagaagacctaaattaccaaagaacacgtcttgtttactgacaaatgagcagcctagaaaagagaggacacggctagtatactactgtcgcgngaaggtaaccttaattattacgtggttacgacgggtactag

SEQ ID NO: 354826 - DNA, 539 bp, Homo sapiens
  misc_feature: GZ8MTXP02FGUL4.21.35.D02.1.454.CMB.2.raw
  modified_base (287)..(287): a, c, t, g, unknown or other
  misc_feature (287)..(287): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccaggcaaggggctagagtggctggcagttancgcattcgatggaagcgatatgtactatgcggactccgtgaacgggccgattcaccatctccagagacaattccaaagaaccacgctgtttctgcaaatgagcagcctagaaaagaagaggacacggactgtaatataacgtgtagcgacgaggtacctttatattagtggttcgaagggtacctattgaactacgtcggggaccacggggaaccctggtaaccaccgtcctctcgacgccctccgaacccg

SEQ ID NO: 354827 - DNA, 514 bp, Homo sapiens
  misc_feature: GZ8MTXP02HYYUM.21.35.D02.1.454.CMB.2.raw
  modified_base (247)..(247): a, c, t, g, unknown or other
  misc_feature (247)..(247): n is a, c, g, or t
  modified_base (345)..(345): a, c, t, g, unknown or other
  misc_feature (345)..(345): n is a, c, g, or t
  modified_base (369)..(369): a, c, t, g, unknown or other
  misc_feature (369)..(369): n is a, c, g, or t
  modified_base (453)..(453): a, c, t, g, unknown or other
  misc_feature (453)..(453): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccncagactccaggcaaggggctagagtggctggcagttatcgcattcgatggaagcgatatgtactatgcgactcgtagaaggccatcaccatctcaganacattaccaagaccagctgtttcngacaaatgagcagctagaaagaagagacacggctagtaatataactgtagcgagagtacttatattagtgtacaggtacagttnacgtacgtacgggacgacggacctggaaccgaccgttctcctacgacgtcctaccaaccgg

SEQ ID NO: 354828 - DNA, 621 bp, Homo sapiens
  misc_feature: GZ8MTXP02IFIXB.21.35.D02.1.454.CMB.2.raw
  modified_base (291)..(291): a, c, t, g, unknown or other
  misc_feature (291)..(291): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagtgactttgccatgcacgtgggtccgccagactccgaggcgaaggggctagagtggctggcagttancgctagttcgatggaagcgatatgtactagtgcgactccgtagacggctatcaccatcacagacgacaattaccaaagaccacgtcttagtttaccagtacaaaagtcgaacgacgtaagacccgtaaaggaaaaacgaacggaacgggaaccgaacggtacttagttaaataacgttaaacgtggtacgggcgtaacggtaaggttaacctttaagtttaacttagttcgttacgaacgggtacctagttcgacgttaacggtcgggaccgaacggtaaccctggtaacctacccgtcctccctacgacgtacccgtaccgtaacccgg

SEQ ID NO: 354829 - DNA, 555 bp, Homo sapiens
  misc_feature: GZ8MTXP02FT4AP.21.35.D02.1.454.CMB.2.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (349)..(349): a, c, t, g, unknown or other
  misc_feature (349)..(349): n is a, c, g, or t
  modified_base (376)..(376): a, c, t, g, unknown or other
  misc_feature (376)..(376): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccaggcaaggggctagagtggctggcagttancgcattcgatggaagcgatatgtactatgcggactccgtgaagggcattcaccatctcaganacaatccaaagaaccacgtctgtttcngacaaatgagcagctagaaagaagaggaacacggtatagtaatataacgtgtgcgacgaggtacttattagttataggttacagggtactagttagaacttacggtcggggaccaacggggtaaccccttcggtaacctacccggtccgtaccctaccgacgtccctacccaaacccgg

SEQ ID NO: 354830 - DNA, 615 bp, Homo sapiens
  misc_feature: GZ8MTXP02H5380.21.35.D02.1.454.CMB.2.raw
  modified_base (247)..(247): a, c, t, g, unknown or other
  misc_feature (247)..(247): n is a, c, g, or t
  modified_base (392)..(392): a, c, t, g, unknown or other
  misc_feature (392)..(392): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagctccaggcgaagggctagagtggctggcagtatcgcattcgagtggaagcgaatatgtaactatgcgactccgtagaacggcgatcacatctacaagagacaattaccaaagtaacacgtctagtttcagacaaaatgaancagaccaagaaagaagaaggacaacggacttagtaaatataaacgtgtaggcgacgaacggtaaccttaagttaagttaagttcggttacgaacggggtaacctaagtttacgaaacgtaacggttcgggggaacccgtaacggggtaaaccccgttcgggtaacccgtaaccggttcccttaccccgttaccgtaaccggaccccttacccgaaaaccccgg

SEQ ID NO: 354831 - DNA, 806 bp, Homo sapiens
  misc_feature: GZ8MTXP02H9NUP.21.35.D02.1.454.CMB.2.raw
  modified_base (308)..(308): a, c, t, g, unknown or other
  misc_feature (308)..(308): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtgggtccgccagacctccgaggcgaaggggctagagtggcgtggctagttatcgctattcgatggaancgtaatatagtactagtcgacggactccggtaggaaacgggccgtacttccaaccgtatcctaccaaggaacgacctaaactttacccaaaagtaaacctacgtcgtttagttttaccacgtaaccaaaagttcgaacgaaccaacgggtacccttaaaggggaaaaaaggaaaacggggaaacggggtaaccgaaaccgggggtacctttaaagggttaaacttaaaacgtttaaaaccgtttgggacgggtaaccgggtaccgggtaaaaccgggttaaacccttttaaagtttaaacgttttaaggttacggggtttaaccgggtaaaccgggggttaaacccttaaaggtttttaccggaaaaccgtttaaccgggtaccgggggtaaacccgtaaaccgggggtaaccccctttacgggggttaacccctaccccgggttacccttacccggtacccgtacccgtacccccgttaccccgaaaacccccgggg

SEQ ID NO: 354832 - DNA, 517 bp, Homo sapiens
  misc_feature: GZ8MTXP02GN82J.21.35.D02.1.454.CMB.2.raw
  modified_base (296)..(296): a, c, t, g, unknown or other
  misc_feature (296)..(296): n is a, c, g, or t
  modified_base (423)..(423): a, c, t, g, unknown or other
  misc_feature (423)..(423): n is a, c, g, or t
  modified_base (432)..(432): a, c, t, g, unknown or other
  misc_feature (432)..(432): n is a, c, g, or t
tcagtcgtcgctcgcacgaccggtgctcgatttagcacacgatagttgggtttgggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggagcgtgttccagcctgggacgtccctgagagtctcctgtgcagcctctggattcagcttcagtgactttgccatgcactgggtccnccagactccaggcaaggggctagagtggctggcagttatcgcattccgatggaagcgatatgtactatgcggactccgtgaagggccgattcaccatctccagagacaatacaagacacgctgttcngacaatgancagcctagaaagagagacaggactagtatactaactgtcgacgcgaggtaacctttataagttagtggttacacgggtacctaag

SEQ ID NO: 354833 - DNA, 679 bp, Homo sapiens
  misc_feature: GZ8MTXP02JG9E1.21.35.D02.1.454.CMB.2.raw
  modified_base (249)..(249): a, c, t, g, unknown or other
  misc_feature (249)..(249): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtgggtccnccagactccgaggcaaggggctagagtggctggcagttatcgcatttcgatggaagcgatatgtactagtgcggtactccggtagaaacgggcctattccacctatcctaccgaagaacgacctaaattacccaaaagaaccaccgtctttagtttacctagaccaaaattgaacgacaagacctaaggaaaagaaggaacggaacgaacggtacgtaagttaaagttaaacttaaacgttggtacgggaccggtaacgtaaacgggtaaaccttttaagtttaagttaagttacgggtttacgaacggggtaacctagtttacggaaccgttaacggtacgggggaccgtaaacgggggtaaaccccttgggtaacccgtaacccggttcctaccccgtacgaccgtaccccgttacccgaaaccccgg

SEQ ID NO: 354834 - DNA, 756 bp, Homo sapiens
  misc_feature: GZ8MTXP02IPX9L.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagacctccgaggcaaggggctagagtggctggctagttatcgctagttcgagtggaagcgtatatgtaactagtggccggtacgtccgtaggaaacggggtccaactttccacctatccctacaagacgactaaacttaccgaaagaccacgtcttgtttacctagactaaaagtcgaagcgaagtacccgtaaggaaaagaaacggaacgggaaccgaacggtaccgttaaggttaaattaaacggttaaaccgttgggttacgggacccgggtaccggtaaacgggttaaacccttttaaagtttaaacgtttaacggtttacgggtttaacggaaacgggggttaaacccttaagtttaccgggtaaaccggtttaaaccgggtaccgggggaacccgtaaaacccgggggtaacccccgtttacggggtaaccccgttaaccccggttccctttaccccgaccgtaacccggtacccccgttaaccccgaaaacccccggg

SEQ ID NO: 354835 - DNA, 587 bp, Homo sapiens
  misc_feature: GZ8MTXP02FUFTH.21.35.D02.1.454.CMB.2.raw
  modified_base (247)..(247): a, c, t, g, unknown or other
  misc_feature (247)..(247): n is a, c, g, or t
  modified_base (391)..(391): a, c, t, g, unknown or other
  misc_feature (391)..(391): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcactgggtccncagactccaggcaaggggctagagtggctggcagttatcgcatttcgatggaagcgatatgtactatggcggactccgtaggaaacggggccattccaccatcctcagagacaattccaaagacacgctgttctgacaaatgancagcctagaaagagagacgacggcttagtaatataactggtggacgtacggaaggttaacctttaatttaagttacgttgggtttacgaaggggtacctagtttacgaacgtaacggttcggggaacccgtaacggggtaaccctcgggtcctaacccggttctacccgtccaacgtccccgtaccgaaaccccgg

SEQ ID NO: 354836 - DNA, 638 bp, Homo sapiens
  misc_feature: GZ8MTXP02HVXT8.21.35.D02.1.454.CMB.2.raw
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcgggggaggcgtgttccagcctgggacgtccctgagagtctcctgtgcagcctctggattcagcttcagtgactttgccatgcacgtgggtccgccagacctccgaggcgaaggggctaggagtggctggctagttancgctagttcgagtggaaagcgaatagtgtactagtggaccggactccggtaggaaacggggcctaattccaacctatcctaccgaaggacacctaaattacccaaagaaccacgtcttagtttcagacaaatgacgacagactaaggaaaacggaaggaacggacgaacggtacttagtaataacttaacgtggtacggacgtacggtaacggttaactttaagtttagttacgttcgggttacgaacgggtacctaggttacgaacgttacggcggggaccgaacgggtaaccctcggtaaccgtaccgtcctaccgtacgaccgtccctaacccgaacccgg

SEQ ID NO: 354837 - DNA, 531 bp, Homo sapiens
  misc_feature: GZ8MTXP02G6WVO.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcgactcgtgaaggcattcacatctcagagacaaattccaaagaacacgctgtttctgacaaatgagcagcctagaaaagaagagacacggactgtaataataactggtagcgacgaaggtaccttaattattatggttacagggtacctagttgaactacgtcggggaccacgggaaccctgggtaaccaccgtctccgtcacgcctaccaacccgg

SEQ ID NO: 354838 - DNA, 535 bp, Homo sapiens
  misc_feature: GZ8MTXP02GPQ4A.21.35.D02.1.454.CMB.2.raw
  modified_base (249)..(249): a, c, t, g, unknown or other
  misc_feature (249)..(249): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtgaacgggccatcaccatctcagagacaattccaaagacacgctgttctgactaaatgagcagacctagaaagaagaaggacacggctagtaatataactgtagacgcgagtaccttattacttatgtacgagggtacctagttgactacgtcgggaccgacggacccgtggtcctaccgtcctcctacgacgtcccgtacctaacccg

SEQ ID NO: 354839 - DNA, 602 bp, Homo sapiens
  misc_feature: GZ8MTXP02J01O0.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggaggtcgggggaggcgtgttccagcctgggacgtccctgagagtctcctgtgcagcctctggattcagcttcagtgactttgccatgcacgtgggtccgccagactccaggcaaggggctagagtggctggcagttatcgctatttcgatggaagcgatatgtactagtgcggactccgtagaacgggcctattcaccatctaccagacgacaacttaccaaagtaacacgtcttagtttcagtacaaatgagcagcctagaaaagaagaggacacggactagtaataataacgtgtgggacgacgacggtaacctttaagttaattagttaggttacgaacgggtacctagttacgaacgttaacggtcgggggaaccgaaccggggtaacccgttcggggtaacccaacccggttccgtacccttacgaccggtccctacccgaacccgg

SEQ ID NO: 354840 - DNA, 540 bp, Homo sapiens
  misc_feature: GZ8MTXP02IV9IL.21.35.D02.1.454.CMB.2.raw
  modified_base (376)..(376): a, c, t, g, unknown or other
  misc_feature (376)..(376): n is a, c, g, or t
  modified_base (524)..(524): a, c, t, g, unknown or other
  misc_feature (524)..(524): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaaggccattcaccatctccagagacaattccaaagaaccacgctgtttcngacaaatgagcagctaggaaagagagacacggctagtatataacgtgtgcgacgagtactttagttattagtaggttcaaggggtacctagtttcgaacgtacgtcggggaccaacgggtaccctagggtcacccggtcttacccgtnacgtcctaccgaaccg

SEQ ID NO: 354841 - DNA, 571 bp, Homo sapiens
  misc_feature: GZ8MTXP02F491Y.21.35.D02.1.454.CMB.2.raw
  modified_base (258)..(258): a, c, t, g, unknown or other
  misc_feature (258)..(258): n is a, c, g, or t
  modified_base (298)..(298): a, c, t, g, unknown or other
  misc_feature (298)..(298): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggagcgtgttccagcctgggactccctgagagtctcctgtgcagcctntggattcagtcttcagtgacttgccatgcacgtgggtccncagacctcgaggcaaggggctaggagtggctggctagtatcgctattccgatggaagcgatatgtactagtcggcggtacctccggtaggaacgggccgtattcaccatctaccagacgactaacttaccaaagaaccacgtcttagttacctgactaaagtgaagacacgaccgtaagaaaaggaagaaggaacacgggtactaggtaataactaaacgtgtcgacgacgtaacggtaacctttattaacttagtggttacgacggtactag

SEQ ID NO: 354842 - DNA, 589 bp, Homo sapiens
  misc_feature: GZ8MTXP02JN5SD.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtgaacgggcattcaccatctcagagacaattcaaagaacacgctgtttcagacaaaatgaagcaagacctaggaaaagaaaggagaacacggtactagtaataactaaacgtgtagcgacgaaggtaaccctttaagttaattagtaggttacaacggggtacctaagtttacgaaactacggttacgggggaccgtaaacggggaaccccgtgggtaaccaacccggtttctcccgtacaccggtcccctacccgaaacccgg

SEQ ID NO: 354843 - DNA, 555 bp, Homo sapiens
  misc_feature: GZ8MTXP02GOVU5.21.35.D02.1.454.CMB.2.raw
  modified_base (248)..(248): a, c, t, g, unknown or other
  misc_feature (248)..(248): n is a, c, g, or t
  modified_base (358)..(358): a, c, t, g, unknown or other
  misc_feature (358)..(358): n is a, c, g, or t
  modified_base (394)..(394): a, c, t, g, unknown or other
  misc_feature (394)..(394): n is a, c, g, or t
  modified_base (405)..(405): a, c, t, g, unknown or other
  misc_feature (405)..(405): n is a, c, g, or t
  modified_base (430)..(430): a, c, t, g, unknown or other
  misc_feature (430)..(430): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagacctcgaggcaaggggctaggagtggctggctagttatcgctattcgatggaagcgaatatgtactagtggcggactccggtaggaacgggccattccaccatccnccaagacgacaacttaccaaagaacacgcttgttcngactaaatgancagacctagaaagaagagacacggntagtaatataacgtgagcgcgtaagtacttaattattagtggttacaggtacctagttgacttacggcggggaccacgggtaccctggtaaccaccgtcctccgtacgacgtccctaccgaaccg

SEQ ID NO: 354844 - DNA, 667 bp, Homo sapiens
  misc_feature: GZ8MTXP02H19IB.21.35.D02.1.454.CMB.2.raw
  modified_base (249)..(249): a, c, t, g, unknown or other
  misc_feature (249)..(249): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgctacgtgggtcccncagacctccaggcgaaggggctagagtggctggcagttatcgctattcgatggaagcgaatatgtactatggcgactccgtaggaacggggcctacttccgaacctatcctaccgagacgactaaacttaccaaagtaaccacgtcttgttttacacgtacaaagtgacgcaagccgtaagaaagaaggaacggacgaacggtactaggtaaataagttaaacgtggtacgacgacggtaaacgtaacccgtttaatttaaacgtttaagttaggttacgtaaacggggtacctaaaggtttacgaacgttaccgggtacggggtacccgtaaaccgggtaaacccgttcgggtaacccgtacccggttaccgtaccccgttaccgacccggtaccccgttaacccgaaacccccggg

SEQ ID NO: 354845 - DNA, 608 bp, Homo sapiens
  misc_feature: GZ8MTXP02G5DOT.21.35.D02.1.454.CMB.2.raw
  modified_base (248)..(248): a, c, t, g, unknown or other
  misc_feature (248)..(248): n is a, c, g, or t
  modified_base (285)..(285): a, c, t, g, unknown or other
  misc_feature (285)..(285): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccncagctccaggcaaggggctagagtggctggctagtancgcattcgatggaagcgatatgtactatggcggactccggtggaacgggcctattccacctatcctaccaaggacacctaaattacccgaaaagaccacgtcttagtttcctagactaaatgagcagctaaggaaagaaggaggacacggtactagtaataacgtaacgtggtacggcgacggtaacggttacctttaagttacttagtacggttacgaagggtaacctagtttcggacttaacggtcgggggacctaacggggtaacccttgggtaacccaccggttcctacccgtaccgtacgtacccctaccgaacccgg

SEQ ID NO: 354846 - DNA, 583 bp, Homo sapiens
  misc_feature: GZ8MTXP02FWMEU.21.35.D02.1.454.CMB.2.raw
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccncagactccgaggcaaggggctagagtggctggctagttancgcattcgatggaancgatatgtactatgcggactcgtagaacggccattccacatcctacagacgacaattaccaaagaaccacgtcttagttctagacaaaatgaagcagactaaggaaaagaaggacggaacacggattaagtaataataacgtgacggcgacggtaaggtacctttaatttaattagtaggttacaagggtaacctagttagaacgtacggtcgggggaccaacgggtaaccctggtaaccctaccgttcctaccacgaccgtaccctaccgaaacccgg

SEQ ID NO: 354847 - DNA, 567 bp, Homo sapiens
  misc_feature: GZ8MTXP02FJ2EP.21.35.D02.1.454.CMB.2.raw
  modified_base (247)..(247): a, c, t, g, unknown or other
  misc_feature (247)..(247): n is a, c, g, or t
  modified_base (287)..(287): a, c, t, g, unknown or other
  misc_feature (287)..(287): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccgaggcaaggggctagagtggctggcagttancgcattcgatggaagcgatatgtactatgcggactccgtagaacgggccattccaccatcctccagacgacaattccaaagaaccacgtcttgtttctagactaaaatgagcagacctagaaagaagagacgacggctagtatataacgtgtacgacgacgaggtacctttattattagtggttacacgggtaccagttcgacgttacgtcggggaccaacggggaacccttggtaaccgacccgttcctcccgtacgaccgtaccctaccgaaacccgg

SEQ ID NO: 354848 - DNA, 678 bp, Homo sapiens
  misc_feature: GZ8MTXP02G467P.21.35.D02.1.454.CMB.2.raw
  modified_base (248)..(248): a, c, t, g, unknown or other
  misc_feature (248)..(248): n is a, c, g, or t
  modified_base (290)..(290): a, c, t, g, unknown or other
  misc_feature (290)..(290): n is a, c, g, or t
  modified_base (307)..(307): a, c, t, g, unknown or other
  misc_feature (307)..(307): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagacctccaggcgaaggggctaggagtggctggcagttancgctattcgagtggaancgatatgtactagtgacggactccggtaggaacggggtcctacgttccacctatcctaccgaagacgactaaacttacccaaagtaaccaccgtctttgtttacagactaaacgtgaacgacaacgaccgtaaggaaaacgaaggaacgggaaccgacgggtactagttaaataagttaacgtggtacggccggtaacggtaacggttacctttaaagtttacgttagttagggttacgaacgggtaaccttagttacgaaccgttacgggtacggggtaccgttaaaccgggggtaaccccttgggtaaccccgtaacccggttcccttacccgtacccgtaccgtacccccgttacccgaaaccccggg

SEQ ID NO: 354849 - DNA, 597 bp, Homo sapiens
  misc_feature: GZ8MTXP02H9JNX.21.35.D02.1.454.CMB.2.raw
  modified_base (249)..(249): a, c, t, g, unknown or other
  misc_feature (249)..(249): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcacgtgggtccnccagactccaggcaaggggctagagtggctggcagttatcgctattcgatggaagcgatatgtactatgcgactccgtagaacgggccatcaccatctacagagactaattccaaagaacacgtctgtttcagacaaatcgaagcaagacctaaggaaaagaaggaacggacaacggactagtaataataaacgtgtacgcgaggaacggtaccttaagtttattagtaggttacgaacggggtaccaagtttcgaaccttacggtacgggggacccgtaacggggtaacccctgggtaacccgtacccggttacctcccgtacgaccgtcccctaaccgaaccccgg

SEQ ID NO: 354850 - DNA, 650 bp, Homo sapiens
  misc_feature: GZ8MTXP02JUL1H.21.35.D02.1.454.CMB.2.raw
  modified_base (371)..(371): a, c, t, g, unknown or other
  misc_feature (371)..(371): n is a, c, g, or t
tcagtcgtcgctcgcacgaccggtgctcgatttagcacacgatagttgggtttggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggaggtcgggggaggcgtgttccagcctgggcgtaaaaaaccctgagagtctcctgtgcagcctctggattcagcttcagtgactttgccatgcactcgggtccgccagactccgaggcgaaggggcgtagagtggcgtggcagttatcgcattccgagtggagcgatatntacgtatgcgacgtccgtaggaacgggccgtagttccaacctatccctacccgaagtaacgaacctaaacttacccaaaggaaacccacgtacttgttttaccaggacctaaaagttcgggaaacgaccaacggacccttaaagggaaaaaggaacggaaggggaaaccaacggggtactaggttaaataaacgtaaaccgttggtacgaccggtacgtaaacgggtaacctttaagttaacgtttagttacgggttccgaacggggtacctttaacgg

SEQ ID NO: 354851 - DNA, 538 bp, Homo sapiens
  misc_feature: GZ8MTXP02HNFP5.21.35.D02.1.454.CMB.2.raw
  modified_base (248)..(248): a, c, t, g, unknown or other
  misc_feature (248)..(248): n is a, c, g, or t
  modified_base (350)..(350): a, c, t, g, unknown or other
  misc_feature (350)..(350): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccnccagactccaggcaaggggctaggagtggctggcagttatcgcattcgatggaagcgaatatgtactatgcggactccgtagaaggcatcaccatctcaganacaattcaaagacacgctgtttcagacaaatgagcagcctagaaagaagagacacgatagtatataactgtagacgcgagtacttattattagtcgttacgagggtacctagttcgacttacggcgggaccgaacgggtaaccctaggtcccgaccgtccgtaccctcgaccgccctaccgaacccgg

SEQ ID NO: 354852 - DNA, 634 bp, Homo sapiens
  misc_feature: GZ8MTXP02FLIA7.21.35.D02.1.454.CMB.2.raw
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtgggtccncagactccaggcaagggctagagtggctggctagttatcgctattcgagtggaancgaatatgtaactagtcggacggtactccggtaggaaacggggtcctaactttaccaacctatacctaccgaagaacgactaaacttaccgaaaagacctacgtctttgtttacagaactaaaagtgaacgacgaacgtaccgtaaggaaaaacggaacggaaacgggaaccgacggtacgttagtaaacttaacgtaaacgttggtacggacgacggtaaacgttacctttaagttattagtcggtacgaacggtactagtagacgtacgtcgggacctacgggaacctggtaaccgtaccgtctaccgtacgacgtccctacgaaaccg

SEQ ID NO: 354853 - DNA, 576 bp, Homo sapiens
  misc_feature: GZ8MTXP02GK1EK.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatggcgactcgtgaagggcatcaccatctacagagacaattccaaagaaccacgtcttgtttctagactaaaatgagcagacctagaaaagaagaggacacggactagtaatataacgtgtaggcgacgtaaggtacctttaattattagtggttacgaagggtacctagttacgacttacggtcggggaccgaacggggtaaccctacggtaacccgtaccggtcctaccctaccaaacccttcccgaaacccgaaacccggg

SEQ ID NO: 354854 - DNA, 633 bp, Homo sapiens
  misc_feature: GZ8MTXP02IP2T7.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagactccaggcaaggggctaggagtggctggcagttatcgcattcgagtggaagcgatatgtactagtgcgactcgtgaaggccatcaccatctaccagacgactaattaccaaagaaccacgtcttgtttcagacaaagtgagcagacctaaggaaaagaaggagaacgacggtctaggttaataagttaacgtggtagaccgacgtaacggtaacctttaagttaagttagttacggttacgaaacggggtacctaagtttacggtaaccgttaaacgggtcggggtacccgtaaacgggggtaaccccgttcgggtaacccgtaacccggttcccgttaccccgtacgtaacccggtcccgttaaccccgaaaccccggg

SEQ ID NO: 354855 - DNA, 578 bp, Homo sapiens
  misc_feature: GZ8MTXP02HN7HN.21.35.D02.1.454.CMB.2.raw
  modified_base (292)..(292): a, c, t, g, unknown or other
  misc_feature (292)..(292): n is a, c, g, or t
  modified_base (336)..(336): a, c, t, g, unknown or other
  misc_feature (336)..(336): n is a, c, g, or t
  modified_base (349)..(349): a, c, t, g, unknown or other
  misc_feature (349)..(349): n is a, c, g, or t
tcagtcgtcgctcgcacgaccggtgctcgatttagcacacgatagttgggtttgggagaggagcccagcactggaagtcgccggtgtttccattcggtgatcagcactgaacacagaggactcaccatggagtttgggctgacctgggtttcctcgttgctcttttaagaggtgtccactgtcaggtccacctggtggagtcgggggagcgtgttccagcctgggacgtcctgagagtctctgtgcagcctctggattcagtcttcgagtgacttgccatgcactgggcccnccagacctccgaggcaaggggctaaggagtgctggcagtatcgntatccgatggaancgatatgtacagtgcggactccgtaggaaagggcccattcacactcctacagacgacaacttaccaaaacgacacgtcttacgtttactacggaacaaaagtcgaacgacaacggacctaaaggaaaagaaggaacgaacgaacggtactagtaataaacgtaaacgtggtacgaccgacggtaacggtaacttaagttaacttagtacggttacacgggtacctaagg

SEQ ID NO: 354856 - DNA, 618 bp, Homo sapiens
  misc_feature: GZ8MTXP02IN4H5.21.35.D02.1.454.CMB.2.raw
  modified_base (297)..(297): a, c, t, g, unknown or other
  misc_feature (297)..(297): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggaggtcgggggaggcgtgttccagcctgggacgtccctgagagtctcctgtgcagcctctggattcagcttcagtgactttgccatgcacgtgggtcccgccagacctccgaggcgaaggggctaggagtggctggctagttatcgnattcgatggaagcgatatgtactatggcgtactccgtagaacgggcctacttccacctatcctaccgaagaacgacctaaattaccaaagaaaccacgtcttagtttctagacaaatgagacaagactaaggaaaagaagaaggacacggactagtaataataacgtgtgacgacgaagtacttagttattagtaggttacgaacgggtactagttcgaaactacggtacgggggaccgtaacggggtaaccccgttggtaacccgtaaccggttcccttacccgtaccgtaccgtacccccgttaacccgaaaccccggg

SEQ ID NO: 354857 - DNA, 541 bp, Homo sapiens
  misc_feature: GZ8MTXP02J0HJ0.21.35.D02.1.454.CMB.2.raw
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (403)..(403): a, c, t, g, unknown or other
  misc_feature (403)..(403): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacattgcgctccactgtcaggtccacctggtggagtcggggggagcgtgttccagcctgggacgtcccctgagagtctccctgtgcagcctctggattcagcttcagtgactttgccatgcactggtccgccagctccaggcaaggggctagagtggctggcagttatcgcattcgatggaagcgatatgtactatgcggactccgtgaaggccgatcacntctcanagcaaacttaccacgaacacgctgtttctgacaaatgagcagacctagaaaagaaagngacgacggctagttaatataacgttgtcgcgacgaaggaacctttattaattattgggttcaagggtaccattagactacgtcggggaccaacggggaccctggtccaccgtctcctacacgaccctacccgaacccg

SEQ ID NO: 354858 - DNA, 686 bp, Homo sapiens
  misc_feature: GZ8MTXP02H3NWP.21.35.D02.1.454.CMB.2.raw
  modified_base (247)..(247): a, c, t, g, unknown or other
  misc_feature (247)..(247): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtcctgagagtctcctgtgcagcctctggattcagcttcagtgactttgccatgcacgtgggtccnccagacctcgaggcgaaggggctaggagtggcgtggcagttatcgctattcgagtggaagcgatatgtactatgcgactccgtagaacgggccagttccaacctatcctaccaaggacacctaaacgttaccaaaacggtaaaccaacgtccgttagttttacctacgaaccaaaagtcgaaacggactaacgacccgttaaggaaaaacggaaagggaaacgggtaaccgaaccgggtaccttaaggttaaactaaagttaaaacgtggttacggaccggaacgtaaacggtaaccctttaagtttaagtttaacgttagggtttaacgaaacggggtacctaagtttacgaacgttacggtacgggggaacccaacggggtaaacccgtcgggtcctaaccggtcgttacccaacgcctacccgtacccaaacccgg

SEQ ID NO: 354859 - DNA, 771 bp, Homo sapiens
  misc_feature: GZ8MTXP02J4AMF.21.35.D02.1.454.CMB.2.raw
  modified_base (258)..(258): a, c, t, g, unknown or other
  misc_feature (258)..(258): n is a, c, g, or t
  modified_base (307)..(307): a, c, t, g, unknown or other
  misc_feature (307)..(307): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcgggggaggcgtgttccagcctgggacgtcctgagagtctcctgtgcagcctctggattcagtcttcagttgtactttgcctatcgctacgtcggggtcccnccagacctccgaggaccgaaggggctaaggagtggctggactagttacncgctaagtttcggaagtggaagtcgtaattagtacggtactagtcggaccggtactccggtaggaacgggtcctacttaccacatcctacaagtacgactaaacttaacccgaaagaaccgtacgtctttagtttaccagaaacctaaaagtcggaacgaccgtaaacgaccggtaaaaggaaaaaacgggaacgggtaaaccggggaccgtaaaacggggtctttaaagttaaacgtaacgttaaccggtgggtaccgggtaaccgtaacggtaaaccggttttaacctttaaatttaacggtttaacggtcgggttaaaaccggtaacgggttaaccctaaggtttaacggaaaccgtttaaaccgggccgggggtaaccccaaaccgggggttaaccccgttcggtaaccccaacccggtccttacccgaccgacccggttacccctacccggaaacccgg

SEQ ID NO: 354860 - DNA, 533 bp, Homo sapiens
  misc_feature: GZ8MTXP02FIJRJ.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccaggcaaggggctagagtggctggcagttatcgcattcgatggaagcgatatgtactatgcggactccgtgaaggcgattcaccatctcagagacaattccaaagaacacgactgtttctgacaaatgagcagcctagaaagaagagacacggctagtaatataaactgtagcgcgaggtaccttattattatggttcaggtacctattgactacgtcggggccacggggaacccttggtaaccaccggtcctccctacacgccctccgaaacccg

SEQ ID NO: 354861 - DNA, 735 bp, Homo sapiens
  misc_feature: GZ8MTXP02GB86Y.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtcccgccagacctccgaggcgaaggggctagagtggctggcagttatcgcattcgagtggaagcgtatagtagtactagtcggcggacctccggtaggaacgggccgtacttaccacctatcctacaaggacgacctaaacttacccaaagtaaccacgtctttagtttccagaactaaaagtcggaacgaccgaagtacccgtaaaggaaaaacggaaaggaacgggaaccgaaccgggtacttaaacggtaaacttaaacgttaaacgttgggttaccggaccggtacggtaaacggtaccctttttaaagtttaagtttacggttacgggtttacgaaacggggtaaccttaggtttacgtaaccggttaccgggtacgggggtaacccgtaaaccgggggtaaccccttacgggtaacccgttaaaccccggtttacccgtcccgttaaccggacccgtaacccccgtaccccggaaaaccccgg

SEQ ID NO: 354862 - DNA, 662 bp, Homo sapiens
  misc_feature: GZ8MTXP02G59OC.21.35.D02.1.454.CMB.2.raw
  modified_base (299)..(299): a, c, t, g, unknown or other
  misc_feature (299)..(299): n is a, c, g, or t
  modified_base (344)..(344): a, c, t, g, unknown or other
  misc_feature (344)..(344): n is a, c, g, or t
tcagtcgtcgctcgcacgaccggtgctcgatttagcacacgatagttgggtttgggagaggagcccagcactggaagtcgccggtgtttccattcggtgatcagcactgaacacagaggactcaccatggagtttgggctgacctgggttttcctcgttgcttcttttaagaggtgtccactgtcaggtccacctggtggaggtcgggggaggcgtgttccagcctgggacgtccctgagagtctcctgtgcagcctctggattcagtcttcagtgtacttgccatgcacgtgggtccnccagacctcgaggcgaaggggctaggaggtggctggctagttacncgctaattccgagtgggaagtacgattagttgtactagtcggacggtaccgtccggtaggaacgggccgtaattccgacctagtcctaccgaagtacgaacctaacttaccaaaacgacctacgtaccttagtttaccacgaactaaaagtggaactaccgaaaggtacctaaagggaaaaggaacggaacgggaaaccgaacgggtacttaggttaaataaacgttaaaccggtggtacgacggtaccggtaaacggttaaccttttaaagttaacgtttaggttacgggtttaccgaacggggttaacccttaagg

SEQ ID NO: 354863 - DNA, 623 bp, Homo sapiens
  misc_feature: GZ8MTXP02FW8LY.21.35.D02.1.454.CMB.2.raw
  modified_base (298)..(298): a, c, t, g, unknown or other
  misc_feature (298)..(298): n is a, c, g, or t
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
tcagtcgtcgctcgcacgaccggtgctcgatttagcacacgatagttgggtttggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcggggggagcgtgttccagcctgggacgtccctgagagtctcctgtgcagcctctggattcagcttcagtgactttgccatgcactgggtccncagactccaggcaaggggctagagtggctggcagtancgcattcgatggaancgatatgtactagtgcggtactccggtaggaaacggggcccgagttccaccctatcctaccaagacgactaaacttacccaaagaaacctacgtcttacgtttctcggaacctaaaattcggaagaccaacggacccttaaggaaaaacggaaggaaacggaccgaacggggtacttaggtaaattaagtaaacgttggtacggaccggacggtaacggtaaccctttaagtttaacgttaagttcgggtttacgaacggggtaaccttaagg

SEQ ID NO: 354864 - DNA, 693 bp, Homo sapiens
  misc_feature: GZ8MTXP02F2RC0.21.35.D02.1.454.CMB.2.raw
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccncagactccaggcaaggggctagagtggctggcagttancgcattcgatggaagcgtatatgtactagtcggcggtactccggtaggaacggggcctacttaccacctatcctacgaagaacgactaaacttcccaaaagaaacctaccgtctttcgtttacacgaactaaaagtgaacgtacaacgtaccgtaaggaaaacgaaggacggacgacggtactagtaataactaacgtggtaggaccgacggtaacggttacctttaagtttaagtttacggtacgggtttacgaacggggttaccctaggtttaccggtaaaccggtttaaccgggtacgggggtacccgtaaaaccgggggtaaccccgtttccggggtaaccctaaccccggtttcccgtacccctttacggacccggtaccccctaccgtaaaacccccgggg

SEQ ID NO: 354865 - DNA, 541 bp, Homo sapiens
  misc_feature: GZ8MTXP02HGYOA.21.35.D02.1.454.CMB.2.raw
  modified_base (249)..(249): a, c, t, g, unknown or other
  misc_feature (249)..(249): n is a, c, g, or t
  modified_base (317)..(317): a, c, t, g, unknown or other
  misc_feature (317)..(317): n is a, c, g, or t
  modified_base (362)..(362): a, c, t, g, unknown or other
  misc_feature (362)..(362): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (410)..(410): a, c, t, g, unknown or other
  misc_feature (410)..(410): n is a, c, g, or t
  modified_base (416)..(416): a, c, t, g, unknown or other
  misc_feature (416)..(416): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtcccncagactccgaggcaaggggctagagtggctggctagttatcgcattcgatggaagcgatatgtactangcgactcgtgacggcatcacatctcagacactaattccaaagacncgcttgttcagacaaatgancanctagaaagagagacacggctagtanagtacngtgacgagagtacttatattagtgttacaggtacctagttcgactacggtacggggaccaacggggtaaccctggtaacccgtaccggtcttaccgtaccgaccgtacccgtacccgaaacccgg

SEQ ID NO: 354866 - DNA, 581 bp, Homo sapiens
  misc_feature: GZ8MTXP02I9VDD.21.35.D02.1.454.CMB.2.raw
  modified_base (247)..(247): a, c, t, g, unknown or other
  misc_feature (247)..(247): n is a, c, g, or t
  modified_base (287)..(287): a, c, t, g, unknown or other
  misc_feature (287)..(287): n is a, c, g, or t
  modified_base (303)..(303): a, c, t, g, unknown or other
  misc_feature (303)..(303): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagacctccaggcaaggggctagagtggctggcagttancgcatttcgatggaancgatatgtactagtgcggactccgtgaagggccattcaccatcctcagagacaacttaccaaagaaccacgtcttgtttctgactaaaatgaagctaagcctaagaaagaaagaggacacggactagtaatagtaacgtgtcgacgacgtacggtaacctttaattagttataggttacgaagggtacctagtttacgacgttaacggtcggggaccgaaacggggtaacctgggtaacctacccggtctacccgtcacgtcccgtaccgaaacccgg

SEQ ID NO: 354867 - DNA, 593 bp, Homo sapiens
  misc_feature: GZ8MTXP02HT97G.21.35.D02.1.454.CMB.2.raw
  modified_base (290)..(290): a, c, t, g, unknown or other
  misc_feature (290)..(290): n is a, c, g, or t
  modified_base (357)..(357): a, c, t, g, unknown or other
  misc_feature (357)..(357): n is a, c, g, or t
  modified_base (389)..(389): a, c, t, g, unknown or other
  misc_feature (389)..(389): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagactccgaggcgaaggggctagagtggctggcagttancgcattcgatggaagcgatatgtactatgcgactccgtagaacgggccattccaccatcctacaganacaaacttaccaaagaaccacgcttagtttcngacaaatgagcagacctagaaaagaaggagacacgggactagtaatataacgtgtacggacgacgtaaggtacctttaattaacttagttacggttacgaacgggtacctagtttcgaacgttacggtacggggaccgtaaacgggtaccctgggtaacccgtacccgttcctacccgtacgaccgtaccctacccgaacccgg

SEQ ID NO: 354868 - DNA, 493 bp, Homo sapiens
  misc_feature: GZ8MTXP02I0TDJ.21.35.D02.1.454.CMB.2.raw
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
  modified_base (360)..(360): a, c, t, g, unknown or other
  misc_feature (360)..(360): n is a, c, g, or t
  modified_base (476)..(476): a, c, t, g, unknown or other
  misc_feature (476)..(476): n is a, c, g, or t
  modified_base (481)..(481): a, c, t, g, unknown or other
  misc_feature (481)..(481): n is a, c, g, or t
  modified_base (483)..(484): a, c, t, g, unknown or other
  misc_feature (483)..(484): n is a, c, g, or t
  modified_base (486)..(486): a, c, t, g, unknown or other
  misc_feature (486)..(486): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccncagactccaggcaaggggctagagtggctggcagttancgcattcgatggaagcgatatgtactatgcgactcgtgaaggccattcaccatctcagagacatccaaagaccncgattgtttcagcaaatgagcagactagaaagagagacaggactagtatatactgtgacgacgagtacttatacttagtgtacgaggactgtagactagtcgggcacggacctgcncgtcncnncnctacacg

SEQ ID NO: 354869 - DNA, 550 bp, Homo sapiens
  misc_feature: GZ8MTXP02IO778.21.35.D02.1.454.CMB.2.raw
  modified_base (248)..(248): a, c, t, g, unknown or other
  misc_feature (248)..(248): n is a, c, g, or t
  modified_base (285)..(285): a, c, t, g, unknown or other
  misc_feature (285)..(285): n is a, c, g, or t
  modified_base (376)..(376): a, c, t, g, unknown or other
  misc_feature (376)..(376): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgactttgccatgcactgggtccnccagactcaggcaaggggctagagtgctggcagttancgcattcgatggaagcgatatgtactatgcgactccgtgaaggccattccacatctccagacgacaattcccaaagaaccacgctgtttcngacaaatgagcagactagaaagagagacacgactagtatataactgtcgacgcgtaggacctttattaattagttggttacgacgggtacctagttacgacgttacgtacggggtaccaacggggtaacccttgggtaacctaaccgtctcccgtacaccgccctaccgaaccg

SEQ ID NO: 354870 - DNA, 550 bp, Homo sapiens
  misc_feature: GZ8MTXP02H8TWN.21.35.D02.1.454.CMB.2.raw
  modified_base (248)..(248): a, c, t, g, unknown or other
  misc_feature (248)..(248): n is a, c, g, or t
  modified_base (378)..(378): a, c, t, g, unknown or other
  misc_feature (378)..(378): n is a, c, g, or t
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
  modified_base (429)..(429): a, c, t, g, unknown or other
  misc_feature (429)..(429): n is a, c, g, or t
  modified_base (528)..(528): a, c, t, g, unknown or other
  misc_feature (528)..(528): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagctccaggcaaggggctagagtggctggcagttatcgctattcgatggaagcgatatgtactatgcgactccgtagaacggccattccacatctccagagacaattccaaagaccacgactgtttcnganaaatgancagctagaaagagaggacaggctagtatatactggtagcgngagtacttattagttataggttcgacggtactagtttgacgttacggtcgggggacccacggggtaacccctgggtaaccaacccggtcttccccgtanaccgtaccctacccaaacccgg

SEQ ID NO: 354871 - DNA, 600 bp, Homo sapiens
  misc_feature: GZ8MTXP02F4HPW.21.35.D02.1.454.CMB.2.raw
  modified_base (401)..(401): a, c, t, g, unknown or other
  misc_feature (401)..(401): n is a, c, g, or t
  modified_base (412)..(412): a, c, t, g, unknown or other
  misc_feature (412)..(412): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcaggttatcgcattcgatggaagcgatatgtactatggcggtactccggtggaaacggggcctattccacctagtcctaccagacgactaacttacccaaaagaaccacgtcttgtttacngactaaatganacagacctaggaaaagaagacggaacacggtctagtatagtaactgtagacgacgtaggtactttatagttattagggtacgaacggtactagttcgaacgtttacggcggggtaccgtaacgggaacccgttgggtaacccgacccggttcctaccctacgaccggtcccctaacccgaaaccccgg

SEQ ID NO: 354872 - DNA, 716 bp, Homo sapiens
  misc_feature: GZ8MTXP02H44CQ.21.35.D02.1.454.CMB.2.raw
  modified_base (298)..(298): a, c, t, g, unknown or other
  misc_feature (298)..(298): n is a, c, g, or t
  modified_base (337)..(337): a, c, t, g, unknown or other
  misc_feature (337)..(337): n is a, c, g, or t
tcagtcgtcgctcgcacgaccggtgctcgatttagcacacgatagttgggtttggggggagaggagcccagcactggaagtcgccggtgtttccattcggtgatcagcactgaacacagaggactcaccatggagtttgggctgacctgggttttcctcgttgctcttttaagaggtgtccactgtcaggtccactggtggagtcggggggaggcgtgttccagcctgggactccctgagagtctcctgtgcagcctctggattcagcttcagtgactttgccatgcacgtgggtccnccagctccaggcaaggggctagagtggctggctagttancgctattccgagtggaagcgatattcgtatagtcggaccggtactccggtaggaaacggggtcccgtacgttaccacctacgtacctacccgaagtaacgtaaacctaaacttaacccgaaaacgtaaccgtaaccggtaccgtttacggttttacctaggtaacctaaaaggttacgaaacgtaccgaaacggacccgttaaagggaaaaaacggaaagggaaacgggaaaccggaaaccggtaccgttaacgggttaaaattaaacgttaaaacgttcggttacggaccggtaacggtaaacggtaacccgttttaaacgtttaaaagttttacggttaacgggtttaaccggtaacgggggtaaccctttaaacgg

SEQ ID NO: 354873 - DNA, 562 bp, Homo sapiens
  misc_feature: GZ8MTXP02JYQNX.21.35.D02.1.454.CMB.2.raw
  modified_base (248)..(248): a, c, t, g, unknown or other
  misc_feature (248)..(248): n is a, c, g, or t
  modified_base (366)..(366): a, c, t, g, unknown or other
  misc_feature (366)..(366): n is a, c, g, or t
  modified_base (377)..(377): a, c, t, g, unknown or other
  misc_feature (377)..(377): n is a, c, g, or t
  modified_base (387)..(387): a, c, t, g, unknown or other
  misc_feature (387)..(387): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccgaggcaaggggctagagtggctggcagttatcgcattcgatggaagcgatatgtactatgcggactccgtgaacgggccatcaccatctcagagacaattccaaagacncgcttgtttcngacaaatgancagactagaaagagaggacacggctagtatataacgtgtcggcgacgacggtaccttaagtttacttagttcggtacgaggggtaacctagttacggactacggtcggggaccgaacggggtaaccctgggtaaccgtacccgtcctcctaccgacgtacccctaccgaacccgg

SEQ ID NO: 354874 - DNA, 708 bp, Homo sapiens
  misc_feature: GZ8MTXP02FVR2H.21.35.D02.1.454.CMB.2.raw
  modified_base (249)..(249): a, c, t, g, unknown or other
  misc_feature (249)..(249): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccncagactccgaggcaaggggctagagtggctggctagttatcgcattcgatggaagcgatatgtactatgcggtactccggtaggaaacgggccgtattccgacctagttcctaccgaagaacgacctaaacttacccgaaaagtaaacccacggtctttacggttttacctaggaacctaaaagtggaaacgcctaacggtaccgtaaggaaaacgaaaggaacggaaccgtacgggtacttaggtaattaacgtaaacgtggtacggaccggtaccggtaacggttaacctttaagtttaagttaacggttacgggttacggtaaacggggtaaccttaggtttaacggtaaccgttaacgggtacgggggtacccgtaaacgggggtaccccgttacgggtaacccgtacccggttccttacccgtaccgaaccgtcccccgtacccgaaaccccgg

SEQ ID NO: 354875 - DNA, 661 bp, Homo sapiens
  misc_feature: GZ8MTXP02F1IKT.21.35.D02.1.454.CMB.2.raw
  modified_base (272)..(272): a, c, t, g, unknown or other
  misc_feature (272)..(272): n is a, c, g, or t
  modified_base (296)..(296): a, c, t, g, unknown or other
  misc_feature (296)..(296): n is a, c, g, or t
  modified_base (321)..(321): a, c, t, g, unknown or other
  misc_feature (321)..(321): n is a, c, g, or t
  modified_base (334)..(334): a, c, t, g, unknown or other
  misc_feature (334)..(334): n is a, c, g, or t
  modified_base (349)..(349): a, c, t, g, unknown or other
  misc_feature (349)..(349): n is a, c, g, or t
tcagtcgtcgctcgcacgaccggtgctcgatttagcacacgatagttgggtttgggagaggagcccagcactggaagtcgccggtgtttccattcggtgatcagcactgaacacagaggactcaccatggagtttgggctgacctgggttttcctcgttgctcttttaagaggtgtccactgtcaggtccactggtggagtcggggggagcgtgttccagcctgggacgtccctgagagtctcctgtgcagcctctggattcagcttcagtntacttgccatgcacgtgggtcccncagacctcgaggcgaaggggctagngtgctggctagtncgctatccgatggancgatatgtatatggacggactccggtaggaacgggcctagttccaccgtatacctcccgaagacgaacctaaacgttaacccgaaaacgaaaccgtaccgtaccgtttcgtttacgtaacggaacctaaaagttcgggaaacggacctaacggacccgttaaaagggaaaaaggaacgggaaacgtaacggaacgggtacttaaaggttaactaacgttaaacgttggtacggaccggtaccggttaaacggttaaccttttagttaaatttacgggtacggtttaaccggtaacggggtacctttaaacgg

SEQ ID NO: 354876 - DNA, 667 bp, Homo sapiens
  misc_feature: GZ8MTXP02F49R0.21.35.D02.1.454.CMB.2.raw
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcgaaggggctagagtgactggcagttancgcattcgatggaagcgatagtgtactatggacggtactccggtaggaaacggggcctaacttccaacccatcctaccaagacgacctaaacttacccgaaaagaacccacgtacgtttcgtttacctagacctaaaagttcgaagcaaacgcccgtaaaggaaaaagaagaggtaaccgacggacttaagttaaataagttaaacgtggtacgaccggaacgaacggtaaccttttaagtacgtttaagtcgggtttaacgacgggtaacctaggtttacgtaaaccgtaacggttcgggggaccgtaaaccgggtacccgtagggtccctaaacccggtccgttaccccgaccgaaccgtacccctacccgaaccgg

SEQ ID NO: 354877 - DNA, 540 bp, Homo sapiens
  misc_feature: GZ8MTXP02F18QR.21.35.D02.1.454.CMB.2.raw
  modified_base (286)..(286): a, c, t, g, unknown or other
  misc_feature (286)..(286): n is a, c, g, or t
  modified_base (326)..(326): a, c, t, g, unknown or other
  misc_feature (326)..(326): n is a, c, g, or t
  modified_base (368)..(368): a, c, t, g, unknown or other
  misc_feature (368)..(368): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgcagactccgaggcaaggggctagagtggctggcagttancgcatttcgatggaagcgatatgtactatgcggactccgngaagggccattcaccatctccagagacaattccaaagaaccncgacttgttctagacaaatgagcagacctagaaagaagagacgacgctagtatactaactgtagcgacgaggaccttattattagtgttacgaggtacctattgacgtacgtcggggaccaacgggtaaccctggtccgtaccgtctacctacgacgaccctaccgaacccg

SEQ ID NO: 354878 - DNA, 660 bp, Homo sapiens
  misc_feature: GZ8MTXP02JN1Y6.21.35.D02.1.454.CMB.2.raw
  modified_base (249)..(249): a, c, t, g, unknown or other
  misc_feature (249)..(249): n is a, c, g, or t
  modified_base (286)..(286): a, c, t, g, unknown or other
  misc_feature (286)..(286): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccncagacctcaggcaagggctagagtggctggcagttancgcagttcgagtggaagcgatatgtactagtggcggtactccggtaggaaacgggcctattccaacctatcctaccagacactaacttaccaaaagaaccacgtcttagtttctagactaaatgaacgacaacgtacctaaggaaaagaaagaacggaaccgacggtactagttaaataactaacgtggtacggaccgacggtaacggtaacctttagttaacgttaacgtcggtttaacgaacggggttaacctagtttaggaaccgttacgggtaccgggggacccggtaaacggggtaaccccgttacgggtaacccgtaaccggttcccgtacccggtactacccggtacccctacccgtaaacccgggg

SEQ ID NO: 354879 - DNA, 638 bp, Homo sapiens
  misc_feature: GZ8MTXP02JAZ8Y.21.35.D02.1.454.CMB.2.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactccaggcaaggggctagagtggctggcagttancgcattcgataggaagcgatatgtactatgcgtactcgtgaagggccgattcaccatcctccagagacaattacccaaagaaccacgtcttcgtttctacgactaaaagtgaacgcaagacctaggaaaagaacggaaggacgacgggccttagtaacttaagtaaccgttggtggaccggacgtacgggttaaccttttagttaagtttacgttaggggttactaacgggggtacctagtttacggaccgttaaacgggtcgggggtaccgtaaccgggggtaaccccgtttggggaaccctacccggtttcctccccgttaccgacgtccccgttaacccgtaaccccgg

SEQ ID NO: 354880 - DNA, 583 bp, Homo sapiens
  misc_feature: GZ8MTXP02F47A3.21.35.D02.1.454.CMB.2.raw
  modified_base (302)..(302): a, c, t, g, unknown or other
  misc_feature (302)..(302): n is a, c, g, or t
  modified_base (345)..(345): a, c, t, g, unknown or other
  misc_feature (345)..(345): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcggggggagcgtgttccagcctgggacgtccctgagagtctcctgtgcagcctctggattcagcttcagtgactttgccatgcacgtggggtcccnccagacctccgaggcgaaggggctaggagtggctggcagttancgcattccgatggaagcgatatgtactagtggcggtactccggtaggaacgggccattccacctatcctaccagacgaactaacttaccaaagaaccacgtcttgtttctagacaaatcggagacgacgaccgtaaggaaaaggaaggacggacgacggtactagtaataactaacgtgtacgacgacggtaacgtaactttagttacgttacgttcggtacggaacggtaccttagg

SEQ ID NO: 354881 - DNA, 583 bp, Homo sapiens
  misc_feature: GZ8MTXP02F6PE9.21.35.D02.1.454.CMB.2.raw
  modified_base (355)..(355): a, c, t, g, unknown or other
  misc_feature (355)..(355): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgcatttcgatggaaagcgatatgtaactatgcggactccgtgaaagggccgattcaccatctccagancaatccaaagacacgctgttctgacaaatgagcagacctagaaaagaagaggaacacgggactagtaatataaactgtacgcgacgtaggacctttaagttaattagtaggttcgaagggtacctaagttaggaaccgttacgtacgggggtacccgaaacgggggtaaccccgttagggtccgtaacccggttccgtccctaccgtacgaccctacccgaaacccgg

SEQ ID NO: 354882 - DNA, 565 bp, Homo sapiens
  misc_feature: GZ8MTXP02G98AE.21.35.D02.1.454.CMB.2.raw
  modified_base (293)..(293): a, c, t, g, unknown or other
  misc_feature (293)..(293): n is a, c, g, or t
  modified_base (340)..(340): a, c, t, g, unknown or other
  misc_feature (340)..(340): n is a, c, g, or t
  modified_base (406)..(406): a, c, t, g, unknown or other
  misc_feature (406)..(406): n is a, c, g, or t
  modified_base (430)..(430): a, c, t, g, unknown or other
  misc_feature (430)..(430): n is a, c, g, or t
tcagtcgtcgctcgcacgaccggtgctcgatttagcacacgatagttgggtttgggagaggagcccagcactggaagtcgccggtgtttccattcggtgatcagcactgaacacagaggactcaccatggagtttgggctgacctgggttttcctcgttgctcttttaagaggtgtccactgtcaggtccactggtggaggtcgggggagcgtgtccagcctgggacgtcctgagagtctctgtgcagcctctggattcagcttcagtgactttgccatgcacgtgggtcccnccagcctccgaggcgaaggggctaggagtggccgtgggctagttacncgctagttccgagtaggaagcgtatatgtactagtggacggtactcggtagacgggccgtatcacntcacagacgacaactaccaagacncgtcttgttctgacaatgagcagaccgtagaaagaagacgacgacggtactagtaatacgtaaacgtggtacgacgaacggtaggtaaacctttagtttaacgttagttacggtacggtaacggtaccttaaagg

SEQ ID NO: 354883 - DNA, 620 bp, Homo sapiens
  misc_feature: GZ8MTXP02HX3L9.21.35.D02.1.454.CMB.2.raw
  modified_base (247)..(247): a, c, t, g, unknown or other
  misc_feature (247)..(247): n is a, c, g, or t
  modified_base (300)..(300): a, c, t, g, unknown or other
  misc_feature (300)..(300): n is a, c, g, or t
  modified_base (386)..(386): a, c, t, g, unknown or other
  misc_feature (386)..(386): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctcactgtcaggtccacctggtggagtcgggggaggcgtgttccagcctgggacgtccctgagagtctcctgtgcagcctctggattcagcttcagtgactttgccatgcactgggtccncagactccaggcaaggggctagagtggctggcagttatcgcattcgatggaancgatatgtactatgcggactccgtaggaacggggccattccacctatcctccaagacactaacttacccaaaagacctacgtcttnttttccagacaaaagtgaagcaagtacctaaggaaaagaaggaacggacaacgggtacttaggtaaatagttaaactggtcggacggtacgaaggtaacctttattaagtttaagtcggtttacgacgggtaacctagtttagaaccgttacggtcggggaccgtaaacggggaaccccttggtaacccgtcccggttacttcccacgtaccggtaccctacccgaaacccggg

SEQ ID NO: 354884 - DNA, 575 bp, Homo sapiens
  misc_feature: GZ8MTXP02JJLPS.21.35.D02.1.454.CMB.2.raw
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
  modified_base (391)..(391): a, c, t, g, unknown or other
  misc_feature (391)..(391): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagactccaggcaagggctagagtggctggcagttancgcattcgatggaagcgatatgtactatggcggactccgtaggaacgggcctattccaccatcctaccagacgactaaattccaaagaaccacgtcttagtttcngtacaaaatgagacagactagaaagagagacacggactagtaataataacgtgtacgacgacgacggtactttaattattagtaggtacaacgggtacctagttgaaacgttacggtacgggaccgtaacggaacccgtggtaaccaccggttacctccgtacaccgtcccctaccgaacccgg

SEQ ID NO: 354885 - DNA, 626 bp, Homo sapiens
  misc_feature: GZ8MTXP02HB8Y7.21.35.D02.1.454.CMB.2.raw
  modified_base (286)..(286): a, c, t, g, unknown or other
  misc_feature (286)..(286): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgccaggtccacctggttgagtcgggggaggcgtgttccagcctgggacgtccctgagagtctcctgtgcagcctctggattcagcttcagtgactttgccatgcactgggtccgccagactccaggcaaggggctagagtggctggcagttancgctattcgatggaagcgaatatacgtaactagtggacggtactccggtaggaaacggggcctaacttccaacctagtcctaccaagaacgactaaacttaccaaacgaaacgaacgtacgttacgtttactacgtaacaaatagaagacgaacgacgtaagaaaaggaaaggaaaggaacgaacggacgtagtaataataaacgtagtagacgacgaacgtaacttaattaattaagttaggttacgtaacggtaacgtaagtagtaacgtacgtacgggaccggaacggtaaccgtacggtaaccgtaccgtcctcctacacgtacctacccgaaccg

SEQ ID NO: 354886 - DNA, 637 bp, Homo sapiens
  misc_feature: GZ8MTXP02IBTSU.21.35.D02.1.454.CMB.2.raw
  modified_base (249)..(249): a, c, t, g, unknown or other
  misc_feature (249)..(249): n is a, c, g, or t
  modified_base (362)..(362): a, c, t, g, unknown or other
  misc_feature (362)..(362): n is a, c, g, or t
  modified_base (379)..(379): a, c, t, g, unknown or other
  misc_feature (379)..(379): n is a, c, g, or t
  modified_base (401)..(401): a, c, t, g, unknown or other
  misc_feature (401)..(401): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtccnccagacctccgaggcgaaggggctagagtgcgtggctaggttactcgctagttcgagtggaagcgatagtgtactatggacgactccgtagacggctactcacatctacaganacaattaccaaagaacncgtctgttcagaacaaatgacncgagaccgtaaggaaaagaacgacgacgacggtctagtataagtaacgtgcgacgacgtaacggttaaccttaagttaagtttaagttcgggtaacgtaacgggtacctaagtttacggaaaccgttacgggtaccgggggaacccgtaaaccggggtaaccccgttacggggtaacccgtaacccggttccctaccgtaacccgtaccgtacccccgtaacccgaaacccccggg

SEQ ID NO: 354887 - DNA, 803 bp, Homo sapiens
  misc_feature: GZ8MTXP02JGUI1.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgtactttgccatgcactgggtccgccagactccgaggcaaggggctagagtggcgtggctagttactcgactagtttcgagtaggaagcgaatatagttaactagtggaccggtactccggtaggaaacggggccctaactttccaaccgtactccctaccgaaggaacgtacctaaactttaaccccgaaaaggtaaaacccaccggtccgtttagggtttttacccacggtaacctaaaaagttacggaaacggtaccgaaaccggtacccgttaaagggaaaaaacgggtaaacggggaaacggggaacccgtaaaccgggtacgtttaaggttaaaactttaaacgttaaaccgttgggttacggaaccggtacggtaaaacgggttaacccttttaaagtttaaacgtttaggttaacgggttaccgaaaacggggttaacccttaaaggtttaccggaaaccgttaaccggggtacgggggaacccgtaaacgggggtaaaccccgttcgggtaacccgtaaccccggttcctaccccgtacaaccggtccccctaacccgaaaccccggg

SEQ ID NO: 354888 - DNA, 534 bp, Homo sapiens
  misc_feature: GZ8MTXP02IOZB5.21.35.D02.1.454.CMB.2.raw
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
  modified_base (457)..(457): a, c, t, g, unknown or other
  misc_feature (457)..(457): n is a, c, g, or t
  modified_base (489)..(489): a, c, t, g, unknown or other
  misc_feature (489)..(489): n is a, c, g, or t
  modified_base (514)..(514): a, c, t, g, unknown or other
  misc_feature (514)..(514): n is a, c, g, or t
  modified_base (523)..(523): a, c, t, g, unknown or other
  misc_feature (523)..(523): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccaggcaaggggctagagtggctggctagttancgctattcgatggaagcgaatatgtactagtgcggtacctccggtgaaacggggcctattaccacctatcgtaccaggaacgactaattacccaaagaaccacgtcttgtttctagactaaagtgagcagacctaagaaagagaacgacaggctagtaataatactgngacgacgtagtacttatattatgtgaggactntcgactcgcgggacacggacctgcncctctcacncgccacgaacg

SEQ ID NO: 354889 - DNA, 770 bp, Homo sapiens
  misc_feature: GZ8MTXP02GOGKZ.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccgaggcaagggctagagtggctggcagttatcgctattcgatggaagcgtaatatgtaactagtggccggtactccggtaggaaacggggtcctaacttccaaccgtatcctacccgaagaacgacctaaacgtttacccgaaaagtaaacccaccggtctttaggttttacccgtagaaacctaaaaagttcgggaaacgtacccgaaacggtacccgttaaagggaaaaaagggaaacgggaaacgggaaaccgtaaccggggtaacgttaaaggttaaattaaacgtttaaacgtgggttacggaccggtaccggtaaacggttaaacccttttaaagtttaaacggttaagtttacgggggtttaacgaacgggggttaaaccctaaggtttaacggtaaccgttaaacggggttccgggggaacccgtaaaccgggtaccccgttagggtaacccgtaacccggtttccctaccgttaccgaccgtaccccgtaacccgaaaccccggg

SEQ ID NO: 354890 - DNA, 715 bp, Homo sapiens
  misc_feature: GZ8MTXP02JKR6A.21.35.D02.1.454.CMB.2.raw
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggaggtcgggggagcgtgttccagcctgggactccctgagagtctcctgtgcagcctctggattcagcttcagtgactttgccatgcacgtgggtccgcagacctccaggcgaaggggctaggagtggctggctagttancgntattcgatggaagcgatatgtactatcggccggtactccggtaggaaacggggtcctaacttccacctatcctaccgaagacgactaaacttacccgaaaagtaaccaccggtctttacggtttacctacgtaactaaaacgttgaacggactaacggtacccgtaaaggaaaaacggaaagggaacggaaccgaacgggtacttaggttaaattaaacgtaaacgttgggtacggtacggtaccggtaacggttaacccgttttaagtttaacgtttaaggttacgggtttacgaacggggtaaccctaagttacgtaaccgttacggtaccgggggtaccgtaaccgggggtaacccgtagggtaaccccgtacccggttcccgtacccgtacgtacccgtaccccgtaccgaaaccccgg

SEQ ID NO: 354891 - DNA, 543 bp, Homo sapiens
  misc_feature: GZ8MTXP02JIOVO.21.35.D02.1.454.CMB.2.raw
  modified_base (247)..(247): a, c, t, g, unknown or other
  misc_feature (247)..(247): n is a, c, g, or t
  modified_base (369)..(369): a, c, t, g, unknown or other
  misc_feature (369)..(369): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccncagctccaggcaagggctagagtggctggcagttatcgcattcgatggaagcgatatgtactatgcgactccgtgaaggcattcacatctcagagacaattccaaagaacacgcttgtttcngacaaatgagcagctagaaagaagagacacgactagtatataacgtgtcgacgcgaggtacttattattagttggttacgagggtacctagttagacgttacggtcggggaccaacggggtaaccctggtaaccgacccggttctaccctacgacgtcccgtaccgaaacccgg

SEQ ID NO: 354892 - DNA, 891 bp, Homo sapiens
  misc_feature: GZ8MTXP02JONDB.21.35.D02.1.454.CMB.2.raw
  modified_base (249)..(249): a, c, t, g, unknown or other
  misc_feature (249)..(249): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgccatgcacgtgggtccnccagctccgaggcaaggggctagagtggctggcagttatcgctatttcgattggaaagcgtaattatgtaactagttggccggtaaccttccgggtaggaaaccggggtcccgtaacttcccgaaccctacttcccgtacccgaaaaggtaacgaacccgttaaactttaacccccgaaaaacggtaaaacccgtaacccggttcgtttttacgggtttttacccccgtaggttaaaccctaaaaggtttacgaaaccgggtaccgaaacccggtaacccgttaaaggggaaaaaacgggtaaaacggggaaaaccggggtaaaacccgaacccgggggtaacctttaaacggggtttaaaatttaaaaccggtttaaacgttacggggttacgggaccggtaaccgggtaaacgggtttaaacccctttttaagttttaaacggttttaaggtttacggggtttaaccggtaaaaccgggggttaaacccttaaggtttacggttaaacccggtttaaacccggggtccgggggttaaccccgaaacccgggggttaaccccgttacgggttaaccccggtaaccgtttccccgttaaccccgtccgacccgttacccccgttaccccgaaacccccgggg

SEQ ID NO: 354893 - DNA, 604 bp, Homo sapiens
  misc_feature: GZ8MTXP02JS2ED.21.35.D02.1.454.CMB.2.raw
  modified_base (247)..(247): a, c, t, g, unknown or other
  misc_feature (247)..(247): n is a, c, g, or t
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
  modified_base (369)..(369): a, c, t, g, unknown or other
  misc_feature (369)..(369): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccncagactccaggcaaggggctagagtggctggcagttatcgcatttcgatggaagcgatatgtactatgcggactccgtagaaggccatcaccatcncaganacatcaagacagctagtttcngacaaatgagcagactaggaaaagacgaaggaccacggactagtaataataacgtggtcgtacgacgaacggtaacctttagttaacgtttagtaggtttacgaagggtaaccctagttacggtaaaccgttacgttacgggggacccgaaaccgggggtaaccccgttacgggtaaccgtaaccccggttaccgtttccccgacgtaccgtaccccgttaccccaaaccccggg

SEQ ID NO: 354894 - DNA, 577 bp, Homo sapiens
  misc_feature: GZ8MTXP02HQGSA.21.35.D02.1.454.CMB.2.raw
  modified_base (250)..(250): a, c, t, g, unknown or other
  misc_feature (250)..(250): n is a, c, g, or t
  modified_base (394)..(394): a, c, t, g, unknown or other
  misc_feature (394)..(394): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtccnccagactcaggcaaggggctagagtggctggcagttatcgcattcgatggaagcgatatgtactatggcgtactccgtaggaacgggccgtattccacctatcctacaagagacctaattaccaaagaaccacgtcttgtttcngacaaatgagcagacctagaaagaagagacacggatagtataattaacgtgtagcgacgaaggtactttagttattagtggttacaacgggtactagtttcgaacttacggtcgggaccgacgggtaaccctggtaacccgaccgttccgtccctacgtaccggtaccctaccgaaaccccgg

SEQ ID NO: 354895 - DNA, 675 bp, Homo sapiens
  misc_feature: GZ8MTXP02H5LIN.21.35.D02.1.454.CMB.2.raw
  modified_base (247)..(247): a, c, t, g, unknown or other
  misc_feature (247)..(247): n is a, c, g, or t
  modified_base (290)..(290): a, c, t, g, unknown or other
  misc_feature (290)..(290): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagacctccgaggcgaaggggctaggagtggctggcagttancgactagttcgagtggaaagcgaatagtgtactagtggacggtactccggtaggaaacggggtcctaacttaccgaacctatcctaccgaagaacgactaaaacttacccaaaagtaaccacgtctttagtttaccagaaacctaaaagtcgaacgaccgacgtaccgtaaaggaaaacgaaaggaacgggaccaaacgggtactaggtaaataagttaaacgtggtacggacgaaggtaacgttaacctttaataagtttagtcggttacgaacgggtactagttacggaaactaccgggtcgggaacccgtaacgggtaaccccgttggtaacccgtacccggttcttacccgtacgtaccgtaccccgtaaccgaaccccgg

SEQ ID NO: 354896 - DNA, 551 bp, Homo sapiens
  misc_feature: GZ8MTXP02IKUTF.21.35.D02.1.454.CMB.2.raw
  modified_base (246)..(246): a, c, t, g, unknown or other
  misc_feature (246)..(246): n is a, c, g, or t
  modified_base (284)..(284): a, c, t, g, unknown or other
  misc_feature (284)..(284): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactccaggcaaggggctagagtgctggcagttancgcattcgatggaagcgatatgtactatgcgactcgtgaacggcattcactatctcagagactattccaaagaccacgtcttagtttctagactaaagtgagcagacctagaaagagagacacggctagtaatataacgtgtagacgacgaaggtacctttattaacttagttgggttacaggggtaacctagtttcgacgtacgtcggggaccaacgggtaccctggtaaccaccggttcctctacgacgtaccgtacccaaccgg

SEQ ID NO: 354897 - DNA, 569 bp, Homo sapiens
  misc_feature: GZ8MTXP02JG9XO.21.35.D02.1.454.CMB.2.raw
  modified_base (246)..(246): a, c, t, g, unknown or other
  misc_feature (246)..(246): n is a, c, g, or t
  modified_base (283)..(283): a, c, t, g, unknown or other
  misc_feature (283)..(283): n is a, c, g, or t
  modified_base (384)..(384): a, c, t, g, unknown or other
  misc_feature (384)..(384): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactcaggcaagggctagagtggctggcagttancgcattcgatggaagcgatatgtactatgcggactccgtgaaggcatcaccatctccagagactaattccaaagtaccacgtcttgttctgactaaatgancagacctagaaagagagacgacggactagtaatactaacgtgtggacgtacgaacggtacctttagttaatacgttggttacgaacgggtacctagtttcgaacgttacggtacggggaccgtaacggggtaaccctggtaaccgacccgttacgtccgtacaccggtccctacccgaaacccgg

SEQ ID NO: 354898 - DNA, 590 bp, Homo sapiens
  misc_feature: GZ8MTXP02JO580.21.35.D02.1.454.CMB.2.raw
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
  modified_base (362)..(362): a, c, t, g, unknown or other
  misc_feature (362)..(362): n is a, c, g, or t
  modified_base (400)..(400): a, c, t, g, unknown or other
  misc_feature (400)..(400): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtccncagacctccgaggcgaaggggctaggagtggctggcagttancgctattcgatggaagcgatagtgtactagtgcgactccgtaggaacgggtccatccaccatcctcaganacacttacaaagacacgtcttgttctagacaaagtganacagacctagaaagaagacgacgacggtactagtaactaataagtgtaggacgacgtaaggtaccttattacgtagttaggttacgaacgggtactagttacgaacgtacggtacggggtaccgaacgggtaaccctcggtaaccgtaaccgttcctaccctaccgaccgtaccccgtaccgaaccccgg

SEQ ID NO: 354899 - DNA, 785 bp, Homo sapiens
  misc_feature: GZ8MTXP02I60XD.21.35.D02.1.454.CMB.2.raw
  modified_base (300)..(300): a, c, t, g, unknown or other
  misc_feature (300)..(300): n is a, c, g, or t
tcagtcgtcgctcgcacgaccggtgctcgatttagcacacgatagttgggtttggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggaggtcgggggaggcgtgttccagcctgggacgtccctgagagtctcctgtgcagcctctggattcagcttcagtgacttgccatgcacgtgggtcccnccagacctccgaggcgaaggggctaggagtggctggctagttatcgctattccgagtggaagcgtatagtgtactagtcggaccggtacctccgggtaggaaacggggtcccgtaagttacccgaaccctacgttaccccgtaccgaaaggtaaacctaaacctaaaccgttaacccgaaaacgtaaacccgtaaccgttaccgtttacggttttaaccgtacgtaaacgtaaaacggttacgggaaacgtaccgaaacggtaacccgtaaaagggaaaaacgggaaagggaaacggggtaaaacccggtaaccggggttaacgttaaacggttaaaacgtttaaaacggttaaaaccggttcggggtaccggtaaccgggtaaaccggggttaaaaccggtttaaaccgtttttaaacgtttaaaggtttacgggtttaacgggtttaaccgggtaaaccgggggttaaaccctttaaacgggg

SEQ ID NO: 354900 - DNA, 663 bp, Homo sapiens
  misc_feature: GZ8MTXP02JJ90L.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactcgaggcgaaggggctagagtggctggctagttatcgctagttcgatggaagcgatatgtactatgcggtactccggtaggaacgggcctattccgacctatcctaccaagaacgactaaacttaccaaagaaccacgtcttacgtttacagactaaagtgaacgtcaacgtaccgtaagaaaacggaaggaacggacgacggtactagtaataagtaacgtgacggaccgacggtaacggttaacctttaagtttaacgttaaggttacgggttacggaaacggggttaaccttaaggttacggtaaaccggttaccggtacgggggtacccgtaaacggggtaaccccgttggtaaccccgtacccggttcctcccgtaccgaccgtaccccgacccgtaaacccgg

SEQ ID NO: 354901 - DNA, 646 bp, Homo sapiens
  misc_feature: GZ8MTXP02I7ZNC.21.35.D02.1.454.CMB.2.raw
  modified_base (249)..(249): a, c, t, g, unknown or other
  misc_feature (249)..(249): n is a, c, g, or t
  modified_base (368)..(368): a, c, t, g, unknown or other
  misc_feature (368)..(368): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtccncagactccgaggcgaaggggctagagtggctggctagttatcgctagttcgagtggaagcgtatatgtactatggcgactcgagacggcatccacatcacagacactaatccaaagacncgtcttgttcagactaaagtcgaagacagaccgtaaaggaaaacgaaggaaggaccgacgggtacttaggttaaataaacgttaacgtaggtacgggaccgtacggtaaacggttaacctttaagtttaacgtttaggtacgggtttaacgacgggtaaaccttagtttacgaaaccgttacgggtacggggtacccgtaaacggggtaacccgttcggtaacccgtacccggttaccttacccgtcgtaacccgtaccccgtaaccgaaaccccggg

SEQ ID NO: 354902 - DNA, 564 bp, Homo sapiens
  misc_feature: GZ8MTXP02HG7AA.21.35.D02.1.454.CMB.2.raw
  modified_base (247)..(247): a, c, t, g, unknown or other
  misc_feature (247)..(247): n is a, c, g, or t
  modified_base (283)..(283): a, c, t, g, unknown or other
  misc_feature (283)..(283): n is a, c, g, or t
  modified_base (364)..(364): a, c, t, g, unknown or other
  misc_feature (364)..(364): n is a, c, g, or t
  modified_base (371)..(371): a, c, t, g, unknown or other
  misc_feature (371)..(371): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccncagactcaggcaagggctagagtggctggcagttancgcattcgatggaagcgatatgtactatgcgactccgtgaaggccattcaccatctcagacgacaacttcaaagacacgtntgtttcngacaaatgagcaagctagaaagaagagacaggctagtatataacgtgtagcgacgagtacttagttattagtggttacacgggtacctagttcgtaacgtacggttacgggggacccgtaacggggtaccccgttaggtaacccgtaacccgttccgtccctaccgtaccggtccccttacccgaaaccccgg

SEQ ID NO: 354903 - DNA, 728 bp, Homo sapiens
  misc_feature: GZ8MTXP02JIODT.21.35.D02.1.454.CMB.2.raw
  modified_base (251)..(251): a, c, t, g, unknown or other
  misc_feature (251)..(251): n is a, c, g, or t
  modified_base (290)..(290): a, c, t, g, unknown or other
  misc_feature (290)..(290): n is a, c, g, or t
  modified_base (293)..(293): a, c, t, g, unknown or other
  misc_feature (293)..(293): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgtactttgccatgcacgtgggtccncagacctcgaggcgaagggctagagtggctggcagttancgntattcgagtggaagcgatagtgtactagtcggcgtactccggtaggaaacgggcctacgttccacctacttccgtaccgaaagtaacgtactaaacgtttacccgaaaacggtaaaccaccggttctttacggttttacacgtaacctaaaaacgttgaacggccaaaacggacccgttaaggaaaacggaaaggaacggaacgacgggtacttaggttaaactaacgttaaaccgttggacggtaccggtaacggtaaccggttaaccttttaagtttacgttaggttacggtttaacgaacggggtaaaccttagttaccggaaacggtttaccgggacgggggtaacccgtaaaccggggtaccccgttacggtaacccgtacccggttacccttaccgaccttacccggtacccctacccgaaaccccggg

SEQ ID NO: 354904 - DNA, 661 bp, Homo sapiens
  misc_feature: GZ8MTXP02HV6EF.21.35.D02.1.454.CMB.2.raw
  modified_base (207)..(207): a, c, t, g, unknown or other
  misc_feature (207)..(207): n is a, c, g, or t
  modified_base (248)..(248): a, c, t, g, unknown or other
  misc_feature (248)..(248): n is a, c, g, or t
  modified_base (292)..(292): a, c, t, g, unknown or other
  misc_feature (292)..(292): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctntggattcagcttcagtgactttgccatgcacgtgggtcccnccagacctccgaggcgaaggggctaggagtggctggacagttancgctattcgagtggaagcgtaatatgtactagtcgacggtactcggtaggaacggtccgtacttccgaacctagtcctaccgaagaacgtacctaaacttaccaaaagtaacctacgtcgtttacgtttaccacgtaacaaagtgaacgcaacgtaccgtaaggaaaacggaagaacggtacgaacggtcttaagttaataacgtaaagtggtacggaccgtacggtaaacggttaactttagttaacgtttagttacggttacgaacgggtaccttagttacgtaaccgtacggtacggggaccgtaacggtacccgtaggtaacccgtacccggtcttaccgacgtaccgtccctaaccgaacccgg

SEQ ID NO: 354905 - DNA, 689 bp, Homo sapiens
  misc_feature: GZ8MTXP02ITT63.21.35.D02.1.454.CMB.2.raw
  modified_base (299)..(299): a, c, t, g, unknown or other
  misc_feature (299)..(299): n is a, c, g, or t
  modified_base (414)..(414): a, c, t, g, unknown or other
  misc_feature (414)..(414): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcgggggaggcgtgttccagcctgggacgtccctgagagtctcctgtgcagcctctggattcagcttcagttgtactttgccatgctacgtgggtcccgccagacctccgaggcgaaggggctaggagtggctggactagttancgctagttcgagtggaagcgtaattagtgtaactagtcggacggtacgtccggtaggaaacggggcctattccacctactctaccgaagacactaacttaccaaagacctacgtnttacgtttcagactaaagtgacgacgtaacgaccgtaaaggaaaagaaacgggaacggaaccgaacgggtacttaaggtaaataacgttaacgtggtacggacggtacggtaacggttaacctttaattacgtttaggtacggtttacgaacggggttaacctagttacggtaaccgttacgggtaccggggtacccgtaaccggggtaaccccgtggtaacccgtaaccgttccgttaccctaccgacccggtaccccttaacccgaaacccgg

SEQ ID NO: 354906 - DNA, 628 bp, Homo sapiens
  misc_feature: GZ8MTXP02HDX41.21.35.D02.1.454.CMB.2.raw
  modified_base (251)..(251): a, c, t, g, unknown or other
  misc_feature (251)..(251): n is a, c, g, or t
  modified_base (295)..(295): a, c, t, g, unknown or other
  misc_feature (295)..(295): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagttgtactttgccatgcacgtgggtcccnccagacctccgaggcgaaggggctaggagtggctggctagttancgcattcgagtggaaagcgaatagtagtactagtcggcggtactccggtaggaaacggggtcctaattccaacctatcctaccgaagaacgactaaacttccaaaagtaccacgtcttagtttcagacaaatgacgcagactaaggaaaagaaggaacgacgacggacttagtaactaattacgagtcggaccgacgtaacgtaacctttagttaagttagttagggtacaacgggtaacctagttacgaacgtacgggtacggggaccgtaaccggggtaacccttcgggaaccctaccgtcctaccgtacgccgaccctacccgaacccgg

SEQ ID NO: 354907 - DNA, 588 bp, Homo sapiens
  misc_feature: GZ8MTXP02F3IQ8.21.35.D02.1.454.CMB.2.raw
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
  modified_base (300)..(300): a, c, t, g, unknown or other
  misc_feature (300)..(300): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccncagactccaggcaaggggctagagtggctggcagttancgcattcgatggaancgatatgtactagtgcggactccgtagaacgggcctattccaccatcctccagacgacaattccaaagaccacgcttgtttctgacaaatgagcagcctagaaagaagagacacgactagtaatataacgtgtacgacgacgtaaggtacctttagttaacgttagtacggttcgaacgggtacctagttacgaacgttacgtcgggggtaccgtaacggggaaccccgttacggtaaccgtaacccggttacttcccgtaccgacgtaccccgtaccgaaaccccgg

SEQ ID NO: 354908 - DNA, 597 bp, Homo sapiens
  misc_feature: GZ8MTXP02HCBMR.21.35.D02.1.454.CMB.2.raw
  modified_base (249)..(249): a, c, t, g, unknown or other
  misc_feature (249)..(249): n is a, c, g, or t
  modified_base (293)..(293): a, c, t, g, unknown or other
  misc_feature (293)..(293): n is a, c, g, or t
  modified_base (352)..(352): a, c, t, g, unknown or other
  misc_feature (352)..(352): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagacctccgaggcgaaggggctaggagtggctggcaggttancgctagttcgagtaggagcgatatgtactagtgcgactcggtgaacggcatcacatccncagacgacaattaccaaagacacgtctgtttacagacaaagtgacgcacgctaaggaaagaagacggactacggactagtaaactagtaacgtggtacggacgtacggtaacggttacctttaagtttaagttaggttacggtacgaacggggtaacctagtttcgaacgttacgggacgggtaccgaacgggtaacccgttggaacccgtaccgtcctcctacgaccgaccctccgaaacccgg

SEQ ID NO: 354909 - DNA, 586 bp, Homo sapiens
  misc_feature: GZ8MTXP02I8SAW.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagctcaggcaaggggctagagtggctggcagttatcgcattcgatggaagcgatatgtactatgcgactcgtgaaggccgattcaccatcctccaagcgacaattacccaaagaaaccacgactgtttcagacaaaatgagacagacctagaaagaaagaggacacggtctagtatataactggtagcgacgtaaggacctttaataattagtggttacgagggaacctagttagacgtaaacggtcgggggtacccgaacggggtaaccccgttgggtaacccgtaacccggttaccttcccgtaccgacccggtcccttacccgaaacccccgg

SEQ ID NO: 354910 - DNA, 585 bp, Homo sapiens
  misc_feature: GZ8MTXP02F97BB.21.35.D02.1.454.CMB.2.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (302)..(302): a, c, t, g, unknown or other
  misc_feature (302)..(302): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttancgcattcgatggaancgatatgtactatgcggtactccgtagaaacgggccgacttcaccatcctaccgagagacctaattacccaaagaaaccacgctttagtttctagactaaatgaagcaagacctagaaaagaagagaacacggactagtaatataacgtgtgacgacgaggtaccttagttattagtacggttacagggacctagttagacttacgcggggtaccgaacgggtaacccttcggtccgtaacccggttcctacccgtaccgtacgacccttacccgaaacccgg

SEQ ID NO: 354911 - DNA, 539 bp, Homo sapiens
  misc_feature: GZ8MTXP02FL0HK.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactcccaggcaaggggctagagtggctggcagttatcgcattcgatggaagcgatatgtactatgcggactccgtgaaggggccgattcaccatctccagagacaattaccaaagaaccacgctgtttctgacaaatgagcagcctagaaagaagaggacacggctagtatataaactgtagcgcgaggtaccttaattacttagtggttcgaagggaccagttagactacgtcggggaccacgggaaccctggtccgaccgtctcctcgacgccctaccaacccg

SEQ ID NO: 354912 - DNA, 630 bp, Homo sapiens
  misc_feature: GZ8MTXP02IHNSD.21.35.D02.1.454.CMB.2.raw
  modified_base (249)..(249): a, c, t, g, unknown or other
  misc_feature (249)..(249): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccgaggcgaaggggctagagtggctggctagttatcgctagtttcgatggaagcgtatagtagtactagtggcggactccggtaggaacgggccattccacctatcctcaagacactaaacttccaaaacgaaacctacgtctttagttttccagtacaaaagttgaacgcaaacgtacctaaggaaaagaaggaaggacgacggacttagtaataattacgtagtgacgtacgaggttaactttattaagtttagttaggtacgaacgggtaacctaagtttacgaacgttacggcgggggtacctaacgggggtaaccctcggggtaacctacccggttcctaccctacgtaccggccctacccgaacccgg

SEQ ID NO: 354913 - DNA, 604 bp, Homo sapiens
  misc_feature: GZ8MTXP02HFGN8.21.35.D02.1.454.CMB.2.raw
  modified_base (256)..(256): a, c, t, g, unknown or other
  misc_feature (256)..(256): n is a, c, g, or t
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
  modified_base (344)..(344): a, c, t, g, unknown or other
  misc_feature (344)..(344): n is a, c, g, or t
tcagtcgtcgctcgcacgaccggtgctcgatttagcacacgatagttgggtttggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggagcgtgtccagcctgggactccctgagagtctcctgtgcagcctntggattcagtcttcagtgtactttgccatgctacgtgggtccnccagacctccgaggcaaggggctaggngtggctggntagtancgnattccgatgaagcgatatgtactagtcggacggactccgggtaggaaacggggtccctaattccgaacctactcctacgagaacgaacctaacttaccgaaagaaccacgtaccttgtttacagtacctaaatgaacgacacgacctaagaaaacgaaggaagacgaacggtactaggtaataagtaaactggtacgacggtacgaaggttaacctttaagttaacgtttacgtaggtttaccgaagggtacccttaagg

SEQ ID NO: 354914 - DNA, 636 bp, Homo sapiens
  misc_feature: GZ8MTXP02HEZ0P.21.35.D02.1.454.CMB.2.raw
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
tcagtcgtcgctcgcacgaccggtgctcgatttagcacacgatagttgggtttgggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggaggtcgggggagcgtgttccagcctgggacgtccctgagagtctcctgtgcagcctctggattcagcttcagtgtactttgccatcgcacgtcgggtccnccagacctccgaggcgaaggggctaggagtggctggcagttancgctattccgatggagcgatatgtactagtgacgactccggtagaacgggccgtattcaccatctacaagagaactaaacttacccaaagaaccacgtactttacggtttactacgtaacaaaagttcggaagaccgaacgaccctaaagggaaaacggaaaggaacgggtaaacgaccgggtacttacggtaaacttaataaaccggttaggtacggaccggtaacggtaacggttaaacctttaagtttaaacgttacggttacggtttaccgaacggggtacccttaaagg

SEQ ID NO: 354915 - DNA, 564 bp, Homo sapiens
  misc_feature: GZ8MTXP02I75NA.21.35.D02.1.454.CMB.2.raw
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccgaggcaaggggctagagtggctggcagttancgcattcgatggaagcgatagtgtactagtgcgtactcgtagagggccattccacctatcctaccagacgactaacttccaaagaaccacgtcttgtttaccagacaaatgaagcagactagaaagagaggacacgntagtatatacngtgacgacgacgtacttattatagtgtacgaggtacctagttcgacgtaggacggggacctaacggggtaaccccgtggtaacccgtaccgttctaccccgtacgaccgtacccgtacccgaacccgg

SEQ ID NO: 354916 - DNA, 652 bp, Homo sapiens
  misc_feature: GZ8MTXP02G6SZW.21.35.D02.1.454.CMB.2.raw
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgccatgctacgtcgggtccgccagacctcgaggcgaaggggcagagtggctggctagttacncgatagttcgagtaggaagcgtaatagtagtactagtcggaccggacgtccggtaggaacgggtccacttccgacctagtcctacgaagacgaacctaaacgttaccaaacggaaacctacggtctttacgtttactagaactaaagtagacgtacaacgtacgaaagaaaacggaagaggacgacggtacttagtaataacgtaagtgtacggacgtacggtaacgtaacctttaagttacgttagttacgggtaacgaacgggtaactacggttacgaacggttacggacgggtacgtaccgggtaaccgtcggtaacctaccggtcctacctaccgtacgaccctaccggaaccg

SEQ ID NO: 354917 - DNA, 595 bp, Homo sapiens
  misc_feature: GZ8MTXP02I8WFE.21.35.D02.1.454.CMB.2.raw
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
  modified_base (361)..(361): a, c, t, g, unknown or other
  misc_feature (361)..(361): n is a, c, g, or t
tcagtcgtcgctcgcacgaccggtgctcgatttagcacacgatagttggggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctcgtggattcagcttcagtgactttgccatgcacgtgggtccnccagactcaggcaaggggctaggagtggctggcagtatccgnattcgatggaagcgatatgtactagtgcggactccgtaggaagggccgattccactatcctcaaggacncgtaaacttccgaaagaaccacgtcttaggtttcacgacaaatgagcaagcctagaaagagagacacggctagtactatactgtgacgacgaggtaccttagttaatgttaggtacgaacgggtaactagtttcgacgttaaacgtcgggggtacctaacgggggtaccccgttagggtaaccgtaacccggttctaacccgttcgacggtaccccttaacgtaaaccccgggg

SEQ ID NO: 354918 - DNA, 598 bp, Homo sapiens
  misc_feature: GZ8MTXP02HKE8L.21.35.D02.1.454.CMB.2.raw
  modified_base (251)..(251): a, c, t, g, unknown or other
  misc_feature (251)..(251): n is a, c, g, or t
  modified_base (292)..(292): a, c, t, g, unknown or other
  misc_feature (292)..(292): n is a, c, g, or t
  modified_base (468)..(468): a, c, t, g, unknown or other
  misc_feature (468)..(468): n is a, c, g, or t
  modified_base (477)..(477): a, c, t, g, unknown or other
  misc_feature (477)..(477): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgccatgcacgtgggtcccnccagactcgaggcgaaggggctagagtggctggctagttancgctagtttcgagtaggaagcgaatagtagtactagcggacgtacgtccggtaggaacggtcctacttaccactactcctacgaagacgactaaacttaccaaagacctacgtcttcgttacagaacaaagtgacacgtacgacgaaagaaaagaacgacgacagtactaagttanaacgttacnggtacgacgtacgtaagtttactttaattacgttagtcggtacgaaggtacctagttcgaacgtcgggacggaccgacggtacctggaaccctcgtacctcgacacgtacccacgaaccgg

SEQ ID NO: 354919 - DNA, 659 bp, Homo sapiens
  misc_feature: GZ8MTXP02H6XFS.21.35.D02.1.454.CMB.2.raw
  modified_base (248)..(248): a, c, t, g, unknown or other
  misc_feature (248)..(248): n is a, c, g, or t
  modified_base (410)..(410): a, c, t, g, unknown or other
  misc_feature (410)..(410): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagttgactttgccatgcacgtgggtccnccagacctccgaggcgaaggggctaggagtggctggcagttatcgacagttcgagtggaagcgtaatagtagtactagtgaccggactcccggtaggaacgggcctaactccaacctatcctaccaagaacgactaaacttaccaaagtaaccacgtctttnttacagtacaaagtcgacgacgacgtacgtaagaaaagaaggacgacgacgtacgtagttaaacttaagtaacgtggtacggacgtacggtaaacgttaactttaagtttaagtttagtacggttacgtaacggtactaagtttacggaacgttacgggtacggggaaccgtaaccggggtaacccgttacggtaacccgtaccgttaccgtacccgtaccgtacccgtaccccgtacccgaaacccgg

SEQ ID NO: 354920 - DNA, 585 bp, Homo sapiens
  misc_feature: GZ8MTXP02IXYLM.21.35.D02.1.454.CMB.2.raw
  modified_base (291)..(291): a, c, t, g, unknown or other
  misc_feature (291)..(291): n is a, c, g, or t
  modified_base (307)..(307): a, c, t, g, unknown or other
  misc_feature (307)..(307): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcatgtgcagcctctggattcagtcttcagtgactttgccatgcacgtgggtccgccagactccgaggcaaggggctaggagtggctggcagttacncgctattcgatggaancgatatgtactagtgcgactccgaggacggccgattcgaccatctaccgaagacgaactaaacttacccgaaaagaaccacgtcttgtttactagactaaagtgaagcacgacctaaagaaaagaaggagaacgacggacttaggtaatataacgtggtacgcgacgaacggtactttaattagttagtcgttacgacggtactagttacgaacgtacggtcggggaccctaacgggtaacctcggtacctaccgtctacccgtacacgtccctaccg

SEQ ID NO: 354921 - DNA, 715 bp, Homo sapiens
  misc_feature: GZ8MTXP02IZXAJ.21.35.D02.1.454.CMB.2.raw
  modified_base (247)..(247): a, c, t, g, unknown or other
  misc_feature (247)..(247): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggactccctgagagtctcctgtgcagcctctggattcagtcttcagtgactttgccatgcacgtgggtccncagactccaggcaaggggctagagtgctggcagttatcgactagttcgagtggaagtcgatatgtactagtcggacggtaccgttcgtaggaaacggggtccctaatttcccgaaccctattccctacccgaaggtaacgacctaaacgttacccgaaaagtaaccctaccgtctttacggttttacacgtactaaaagtcgaacgacgacgtacccgtaaggaaaacgaaaggaacgggaaccacggtaccgttaagttaaagttaaactttaaacgtcgggacggtacccggacgtaacggttaacctttagtttaaacgtttacggttacgggttacgaacggggtaacctagtttaaacggtaccgtaacggttaccggggaccgtaaaccgggtacccgtttacgggtaaccctacccggttccttacccgtaccgtaccgtccccgttaacccgaacccggg

SEQ ID NO: 354922 - DNA, 742 bp, Homo sapiens
  misc_feature: GZ8MTXP02GCT44.21.35.D02.1.454.CMB.2.raw
  modified_base (240)..(240): a, c, t, g, unknown or other
  misc_feature (240)..(240): n is a, c, g, or t
  modified_base (346)..(346): a, c, t, g, unknown or other
  misc_feature (346)..(346): n is a, c, g, or t
tcagtcgtcgctcgcacgaccggtgctcgatttagcacacgatagttgggtttgggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggaggtcgggggaggcgtgttccagcctgggacgtccctgagngtctcctgtgcagcctctggacttcagtcttcagtgtactttgccatgcacgtcgggtaccacagacctccgaggacgaaggggctaggagtggctggctagttancgctagttcgagtggaagcgaattagtagtactagtcggaccggtacgtcccgggtagggaaacggggtcccgtaacgttcccaaccctacgttaccgtacccaaaggtaacgaaacctaaacgttaaacccgaaaacgaaaaccgtaccgttacctttacggtttaccttaggtaacctaaaaaggttcggaacgtaacccgaacggtaaccctaaagggaaaaacggaaaacgggaaacgggaaccgtaacggggtaccttaaggttaaacgttaaacgttaaaaccggttggtacggtaccgggtaaccggtaaacgggtttaacccttttaagttttaaacgtttaacggtttacggggtttaaccgtaaacgggggtacccgtttaaacgg

SEQ ID NO: 354923 - DNA, 533 bp, Homo sapiens
  misc_feature: GZ8MTXP02IMT19.21.35.D02.1.454.CMB.2.raw
  modified_base (348)..(348): a, c, t, g, unknown or other
  misc_feature (348)..(348): n is a, c, g, or t
  modified_base (351)..(351): a, c, t, g, unknown or other
  misc_feature (351)..(351): n is a, c, g, or t
  modified_base (356)..(356): a, c, t, g, unknown or other
  misc_feature (356)..(356): n is a, c, g, or t
  modified_base (369)..(369): a, c, t, g, unknown or other
  misc_feature (369)..(369): n is a, c, g, or t
  modified_base (380)..(380): a, c, t, g, unknown or other
  misc_feature (380)..(380): n is a, c, g, or t
  modified_base (429)..(429): a, c, t, g, unknown or other
  misc_feature (429)..(429): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtcgggtccgccagacctccgaggcgaaggggctaggagtggctggcagttatcgctagttcgatggaagcgaatatgtactagtgcgactcgtgaaggccattcacntcncaganacaatccaagacncgtctgtttcngacaatgagcagacctagaaagaagagacacggctagtataatacgtgngcgagacgtacttattatatggtacaggtactgttagactacggacgggtacgacggtaacccgtggtaacctaccgtctcctcgaccgtccctaccgaacccg

SEQ ID NO: 354924 - DNA, 605 bp, Homo sapiens
  misc_feature: GZ8MTXP02FOVG6.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactagacacaacatttgcgctccactgtcaggtccacctggtggagtcgggggaggcgtgttccagcctgggacgtccctgagagtctcctgtgcagcctctggattcagcttcagtgtactttgccatgcacgtgggtccgccagactccgaggcaaggggctagagtggctggcagttatcgcattcgatggaagcgaatatgtactagtgcggactcgtagaacggtaccgattccactatctaccgagacgactaacttaccaaaagaaccacgtctttagtttcctagactaaagtgaagcagacctaaggaaagaagacgacgacggtatagtaaatactaacgtgtacgacgacgaagtacttaattagtagttacggttacgacggtaactagttacgaacgttacggcggggaccgtaacggggtaaccccgttggtaacccgtacccgttacctcccgtaccgacggtacccctaaccgaaacccggg

SEQ ID NO: 354925 - DNA, 683 bp, Homo sapiens
  misc_feature: GZ8MTXP02JARXH.21.35.D02.1.454.CMB.2.raw
  modified_base (248)..(248): a, c, t, g, unknown or other
  misc_feature (248)..(248): n is a, c, g, or t
  modified_base (291)..(291): a, c, t, g, unknown or other
  misc_feature (291)..(291): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtgggtccnccagacctccgaggcgaaggggctagagtggctggctagttancgctagttcgagtggaaagcgtaatatagtactagtcgcggtactccgaggaacgggcctagttccacctatcctccaagacactaacttaccgaaaagaaccacgtcttgtttacagaactaaagtgaacgacgaacgtacctaaggaaaaaggaaacggaacggaaccgacgggtactagtaaattaaagttaacgtggtacggacgtacggtaacggttaacctttaaagtttaacgttaagttacgggttaacgaacgggtaacctaagttacggtaaaccgttaacgggtaccgggggaacccgtaaacgggggtaaacccccgttagggtaacccgtaacccggttcctacccgttaccgaccgtaccccgtaaccccgaaaccgg

SEQ ID NO: 354926 - DNA, 585 bp, Homo sapiens
  misc_feature: GZ8MTXP02IKE5F.21.35.D02.1.454.CMB.2.raw
  modified_base (248)..(248): a, c, t, g, unknown or other
  misc_feature (248)..(248): n is a, c, g, or t
  modified_base (302)..(302): a, c, t, g, unknown or other
  misc_feature (302)..(302): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagctccaggcaaggggctagagtggctggcagttatcgcatttcgatggaancgatatgtactatgcggactcgtgaagggccatcaccatctaccagagactaattccaaagaccacgtctcgtttctagactaaatgagcaacggcctaaggaaaacgaaggaaggacacggtctagtaataactaacgtgtgacgcgaggtactttagttattagtaggttacgacgggtacctagttcgaccgtacggtacggggccgtaaaccggggtacccgttacggtccgtaacccggtccttacccgtccgaccgtacccctaccgtaaaccccgg

SEQ ID NO: 354927 - DNA, 596 bp, Homo sapiens
  misc_feature: GZ8MTXP02FNGWY.21.35.D02.1.454.CMB.2.raw
  modified_base (248)..(248): a, c, t, g, unknown or other
  misc_feature (248)..(248): n is a, c, g, or t
  modified_base (347)..(347): a, c, t, g, unknown or other
  misc_feature (347)..(347): n is a, c, g, or t
  modified_base (352)..(352): a, c, t, g, unknown or other
  misc_feature (352)..(352): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccgaggcaaggggctagagtggctggcagttatcgcattcgatggaagcgatatgtactatgcggtactccgtagaagggccatccacatcncagancaatccaaagacagctgttnganaaangancagccagaaagaagagacacggactagtaatataacgtgtacggacgacgaaggtacctttaattaagtttagtacggtttacgaaacgggtacccttaagtttacggaaaccgttacgggtacgggggaccccgtaaaacgggggtaacccgtttcggggtaaccctacccggttacctacccgttcgaaccggccccttacccgaaacccgg

SEQ ID NO: 354928 - DNA, 608 bp, Homo sapiens
  misc_feature: GZ8MTXP02FVLN9.21.35.D02.1.454.CMB.2.raw
  modified_base (249)..(249): a, c, t, g, unknown or other
  misc_feature (249)..(249): n is a, c, g, or t
  modified_base (412)..(412): a, c, t, g, unknown or other
  misc_feature (412)..(412): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtcccnccagacctccgaggcgaaggggctaggagtggctggcagttatcgcattcgagtggaagcgatatgtactagtgcggtactccgtaggaacgggccgtattccaccatcctacaagagactaaattccaaagaaccacgtacttgtttctagactaaagtgancaagacctagaaaagaagaacggacacggtactagtaatagtaacgtgtaggcgacgaggtacctttattaacttagtacggttacgaaggggtaacctagttacgaacgtacggttacgggggaccgtaacggggaaccccttgggtaacccgtaccggttcctacccgtacgaccgtccctacccgaaacccgg

SEQ ID NO: 354929 - DNA, 558 bp, Homo sapiens
  misc_feature: GZ8MTXP02HZ25I.21.35.D02.1.454.CMB.2.raw
  modified_base (246)..(246): a, c, t, g, unknown or other
  misc_feature (246)..(246): n is a, c, g, or t
  modified_base (284)..(284): a, c, t, g, unknown or other
  misc_feature (284)..(284): n is a, c, g, or t
  modified_base (299)..(299): a, c, t, g, unknown or other
  misc_feature (299)..(299): n is a, c, g, or t
  modified_base (337)..(337): a, c, t, g, unknown or other
  misc_feature (337)..(337): n is a, c, g, or t
  modified_base (367)..(367): a, c, t, g, unknown or other
  misc_feature (367)..(367): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggactcctgagagtctcatgtgcagcctctggattcagcttcagtgtactttgccatgcacgtgggtccncagactccaggcaaggggctagagtggctggcagttancgcattcgatggaancgatatgtactatgcgactcgtgaaggccatcacatcncagacacaatccaaagaacacgcttgttcngacaaatgagcagcctaagaaagagagacacggctagtatataacgtgtagcgacgaggtaacttattaagttagtaggttacgacggggaaccttaggttacgaaacggttacgtacgggggacccaaacggggtaaacccgtggtacccgtaaccggtccctacccgtactaacggtcccctaacccgg

SEQ ID NO: 354930 - DNA, 605 bp, Homo sapiens
  misc_feature: GZ8MTXP02HAKGL.21.35.D02.1.454.CMB.2.raw
  modified_base (251)..(251): a, c, t, g, unknown or other
  misc_feature (251)..(251): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtcccnccagactccgaggcgaaggggctaggagtggctggctagttancgctagttcgagtggaaagcgaatatgtactatgcggactccggtgaacgggcatccactatcctcagacactaacttaccaaagaccgtacgtcttagtttcctagaccaaagtgaacgcaagacctaaggaaaacgaaggacgacgacgacttagtaaatataacgtggtcgaccgcgtaaggtaacctttagttataggttgttacgaggtaacctagttacgacgttacggacggggtacccgtaaacggggtacccgtaggtcccgacccgttccgtcctaccgtaccgcccctaccgaaacccgg

SEQ ID NO: 354931 - DNA, 557 bp, Homo sapiens
  misc_feature: GZ8MTXP02FLGXG.21.35.D02.1.454.CMB.2.raw
  modified_base (286)..(286): a, c, t, g, unknown or other
  misc_feature (286)..(286): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
  modified_base (414)..(414): a, c, t, g, unknown or other
  misc_feature (414)..(414): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttancgcattcgatggaagcgatatgtactatgcggactccgtgaacgggccgatcacatcncaganacaatcaaagaacacgtcttgttctgacaaatgagcagcctagaaagaagagacngntagtatanaactgtgcgacgaggtacttagttattagtggttacgaagggtacctagttacgaacttacggtacgggggaccctaacggggtaaccccgtgggtaacccgtaccggtccctacccgtacgacggcccctacccgaacccgg

SEQ ID NO: 354932 - DNA, 632 bp, Homo sapiens
  misc_feature: GZ8MTXP02G4IT9.21.35.D02.1.454.CMB.2.raw
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtccnccagactccgaggcgaaggggctagagtggctggctagttancgctattcgatggaagcgatagtgtactagtggacggtactcggtaggaacggcctattccacactcctacagaacgacctaattacccaaagaacctacgtcttcgtttacagaacaaagtgacgtacacgacctaaggaaaagaaggaacggaacgaccggtactaagttaaataagtaacgtaggtacggacggacggtaacggttaacctttagtttaacgttagttaggtacgtacggtaactagttacgaacgttacggtacgggaccgacgggtaacccgttcggtaacccgtaccgttccctacctacgaccggtcccctaccgaaccccgg

SEQ ID NO: 354933 - DNA, 647 bp, Homo sapiens
  misc_feature: GZ8MTXP02JF19I.21.35.D02.1.454.CMB.2.raw
  modified_base (251)..(251): a, c, t, g, unknown or other
  misc_feature (251)..(251): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggaggtcgggggagcgtgttccagccgtgggacgtccctgagagtctcctgtgcagcctctggattcagcttcagtgtactttgccatgcacgtcgggtccnccagacctccgaggcgaaggggctagagtggcgtggctagttatcgactagttcgagtaggaagcgtaatatgtactagtcggacggtactcggtaggaaacggggtcctacttccgacctactcctaccgaagaacgacctaacttaccaaagaaccacgtctttagtttctagactaaagtgagacacgtactaaggaaagaagacggaaccgacgtacgtagttaaattaacgtacgtggtacggacgaacggtaacgttactttaagtttagttaggttacggtacgaacggtactagttacgaaccgttacggtccggggaccgtaaccgggtacccgtcggtaacccgtacccgtcctacccgtacgacccgtaccccaccgtaacccgg

SEQ ID NO: 354934 - DNA, 539 bp, Homo sapiens
  misc_feature: GZ8MTXP02G6K6B.21.35.D02.1.454.CMB.2.raw
  modified_base (298)..(298): a, c, t, g, unknown or other
  misc_feature (298)..(298): n is a, c, g, or t
tcagtcgtcgctcgcacgaccggtgctcgatttagcacacgatagttgggtttggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggagcgtgttccagcctgggacgtccctgagagtctcctgtgcagcctctggattcagcttcagtgactttgccatgcacgtgggtccnccagactccaggcaaggggctagagtggctggcagttatcgctattccgatggaagcgatatgtactatgcggactccgtagaacgggccgatcaccatcaccagacgacaattccaaagaacacgtctgtttcagtacaaatgagacacgacctagaaaagagaagacgacggactagtaactataaactgtacgacgacgaaggtaaccttaagttattagtggtactacgggacctag

SEQ ID NO: 354935 - DNA, 708 bp, Homo sapiens
  misc_feature: GZ8MTXP02HIIS7.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgttcctgagagtctcctgtgcagcctctggattcagcttcagtgactttgccatgcacgtgggtcccgccagacctccgaggcgaaggggctaggagtggctggctagttatcgctattcgagtggaagcgaatatgtactagtcggcggtactccggtaggaaacgggtcctaattcccaacctacgttcctaccgaagaacgtacctaaacgttcccaaaagggaaccctaccgtcctttaggttttacccacggtaacctaaaagtcggaacggaccaaacggtacccgttaaaggaaaaagggaacgggaaacgggaaccgaccgggtacgttaaaggttaaataaacgttaaacgtgggttacggaccggtacggtaacggttaccctttaagttacttagttacggttacgaacggtacctagttacgacgttacgggtacggggaccgtaaccggggtaccctagggtaacccgtaacccggtcctaccgtaccgacgtaccccgtaacccgaacccgg

SEQ ID NO: 354936 - DNA, 643 bp, Homo sapiens
  misc_feature: GZ8MTXP02GSF9R.21.35.D02.1.454.CMB.2.raw
  modified_base (258)..(258): a, c, t, g, unknown or other
  misc_feature (258)..(258): n is a, c, g, or t
  modified_base (302)..(302): a, c, t, g, unknown or other
  misc_feature (302)..(302): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcggggggaggcgtgttccagcctgggacgtccctgagagtctcctgtgcagcctctggattcagtcttcagttgtactttgcctatgctacgtcgggtcccnccagacctccgaggcgaaggggctaggagtggctggctagttancgactagttcgagtagggaagcgaatatgtactagtcggacggtactccggtaggaaacggggtcctattccaacctatcctacgaagaacgacctaaacttaccaaaagaaccacgtctttagttcagaactaaagtgaacgacaacgtacgtaaggaaaagaacggaacggaccgaacggtattagtaaactaagttaacgtggtacggacgtacgtaagttactttaattacgttagtacggtcgaaggtactagttagacgtacggacggggaccaacgggtaaccgtcggtaaccctacccggttctccgtacgaccgtcccgtaaccgaacccgg

SEQ ID NO: 354937 - DNA, 576 bp, Homo sapiens
  misc_feature: GZ8MTXP02IY5LU.21.35.D02.1.454.CMB.2.raw
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
  modified_base (348)..(348): a, c, t, g, unknown or other
  misc_feature (348)..(348): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcatgtgcagcctctggattcagcttcagtgactttgccatgcactgggtccnccagactccgaggcaaggggctagagtggctggcagttancgcattcgatggaagcgatatgtactatgcggactccgtagacggccctatcaccatcnccagagactaattacccaaagaaccacgtcttgtttctagacaaatgagcagcctaagaaagaagagacacggctagtaatataacgtgtcgcgacgtaggtacctttaattattaagtggtttacaggggtaccctaagttcgtaacgtacgttacgggggacccgtaacggggtaacccttcgggtaccctaccgttccctccctacgaccggtccctaaccccgg

SEQ ID NO: 354938 - DNA, 610 bp, Homo sapiens
  misc_feature: GZ8MTXP02G31U4.21.35.D02.1.454.CMB.2.raw
  modified_base (247)..(247): a, c, t, g, unknown or other
  misc_feature (247)..(247): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccncagactccaggcgaagggctagagtggctggcagttatcgctattcgatggaagtgaatatgtactatgcggactccgtaggaacgggtcctacgttcacctatcctaccgaagacgtactaaacttaccgaaagaaccacgtcttagtttctagactaaatgagtcagactaaggaaacgaagacgacacggtactaggtaactaactaacgtggtacgacgaccggtaaggtacctttaatagttagtggttacgaagggtacctagttacggtaacgttacggtacggggaccgtaacgggtacccgttacggtaaccgtacccgtccgtacctaccgacgtaccccgtacgaaacccgg

SEQ ID NO: 354939 - DNA, 555 bp, Homo sapiens
  misc_feature: GZ8MTXP02J4GGM.21.35.D02.1.454.CMB.2.raw
  modified_base (301)..(301): a, c, t, g, unknown or other
  misc_feature (301)..(301): n is a, c, g, or t
  modified_base (359)..(359): a, c, t, g, unknown or other
  misc_feature (359)..(359): n is a, c, g, or t
  modified_base (425)..(425): a, c, t, g, unknown or other
  misc_feature (425)..(425): n is a, c, g, or t
  modified_base (428)..(428): a, c, t, g, unknown or other
  misc_feature (428)..(428): n is a, c, g, or t
  modified_base (438)..(438): a, c, t, g, unknown or other
  misc_feature (438)..(438): n is a, c, g, or t
tcagtcgtcgctcgcacgaccggtgctcgatttagcacacgataggttgggtttggggggagaggagcccagcactggaagtcgccggtgtttccattcggtgatcagcactgaacacagaggactcaccatggagtttgggctgaccctgggttttcctcgttgctcttttaagaggtgtccactgtcaggtccactgggtggagtcggggggagcgtgtccagcctgggactccctgagagtctcctgtgcagcctctggattcagcttcagtgactttgccatcgcacgtgggtcccncgagacctccgaggcgaaaggggctagagtggctggctagtatcgctattccgatgancgatatgctatgcggactccgagaacgggccattcaccatcaccatagaacaataccaaagaaccnctnttgttactanacaagagagacgacgacgaagaaaggaaggaacgacgaacgtacgtagtaataacgtacgtacgtcgacgtacgtacgttaacgttagttagttacgtacgtacgtacgtacgtacg

SEQ ID NO: 354940 - DNA, 721 bp, Homo sapiens
  misc_feature: GZ8MTXP02GW95C.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttggggggaagaggaagactgacggtcctgccacaggtgttgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccncagactccaggcaaggggctagagtggctggctagttatcgactattcgagtggaagcgtatatgtactagtggacggtactccgtaggaacgggccgtacttccgaaccctatcctaccgaagaacgacctaaacgtttacccgaaaacgaaaccgtacggtacctttacgttttaccgtacgtaacctaaaagtggaacgaccgtaacgtacccgtaaggaaaaacggaaacggaacgggaaaccgaaccgggtattagttaaacgttaaacgttaaacgtggttacgggaccgtaccggtaacggttaaccttttaagttaacgtttagttacgggtttacgaaacggggtaacctagtttacggtaaccgttaacgggtcggggaacccggtaacggggtaaccccgttcggtaacccgtaacccggttcctacccgtaccgtaccgtaccccgtacccgaaaacccgg

SEQ ID NO: 354941 - DNA, 740 bp, Homo sapiens
  misc_feature: GZ8MTXP02IBD6K.21.35.D02.1.454.CMB.2.raw
  modified_base (207)..(207): a, c, t, g, unknown or other
  misc_feature (207)..(207): n is a, c, g, or t
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcatgtgcagcctntggattcagcttcagtgactttgccatgcacgtcgggtcccncagacctccgaggcaagggctagagtgctggctagttacncgctattcgagtggaagcgaattagtagtactagtgacggtactccggtaggaaacgggtcccccgtaattccgaacctattcctaccgaagacgtaaactaaacttacccgaaaagaacctacgtctttacgttaactacgaaactaaaagtcgaacgtaccgaacgtaccgtaaaggaaaacggaaaggaccgggaaacgaccgggtaacttaaggttaaactttaaacgtaaaccggttgggtacggaccgggtaaacggtaaaccggttaaccgtttttaaagtttaagtttacggtttaacgggttaaaccgtaacggggtaacctttaacggttaacgtaaaccgttaaccgggttacgggggaaccccgttaaacggggtaaaccccttcgggtaccctaacccggttcccttacccgtacgaacccgttcccctaacccccgg

SEQ ID NO: 354942 - DNA, 596 bp, Homo sapiens
  misc_feature: GZ8MTXP02IC9FT.21.35.D02.1.454.CMB.2.raw
  modified_base (347)..(347): a, c, t, g, unknown or other
  misc_feature (347)..(347): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagggtacttgtccatgcactgggtccgccagactccaggcaaggggctagagtggctggcagttatcgcatttcgatggagcgatatgtaactatgcggactcgtgaaggccgattcccaccattcnccagacgacacttccaaagaacacgtccttgtttactgactaaangancagcctagaaagaagacggaactcggactagtataactaaacttgagccggacgaggtaaacctttagttaattagttaggtaccgtagggaaaaccttgttacggtactaacgtacgggggacctacggggtaaacccgttggaccgtaacccgttcctccttacccgaaggtcccccttccgaaaccgaaaccccgggg

SEQ ID NO: 354943 - DNA, 570 bp, Homo sapiens
  misc_feature: GZ8MTXP02FVYBE.21.35.D02.1.454.CMB.2.raw
  modified_base (249)..(249): a, c, t, g, unknown or other
  misc_feature (249)..(249): n is a, c, g, or t
  modified_base (303)..(303): a, c, t, g, unknown or other
  misc_feature (303)..(303): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccnccagactccaggcaaggggctagagtggctggcagttatcgcattcgatggaancgatatgtactatgcggactccgtgaaggccattcacatcncaganacaatccaaagaacagcttgtttctgacaaaatgaagcagacctagaaaagaaagaaggaacacggactagtaataataaactgtacgcgacgaggtaacctttaattaacttaagtggttacaagggtaacctagttagaaacttacgtacgggggtaccaaacggggaacccctagggtaaccaaccggtactaccctacaacgccctaccaaaacccg

SEQ ID NO: 354944 - DNA, 599 bp, Homo sapiens
  misc_feature: GZ8MTXP02JNX5A.21.35.D02.1.454.CMB.2.raw
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgactttgccatgcacgtgggtccgccagactcgaggcgaaggggctagagtggctggcagttancgntagttcgagtggaagcgtatagtgtaactagtcgacggtactccggtaggaacgggcctattccaacctatcctcaagacactaattaccaaagaccacgtctttagttctagtactaaagtgagcacgtactagaaagagacgacgacggtactagtaatataacgtgtacgacgacgtagtactttattattagtcgtacgaacggtactagttagaccgttacggtacgggacccgtaacgggtaaccctcgggtaacccacccggttcctacccgtacgtaccgaccccgttaccgaaccccgg

SEQ ID NO: 354945 - DNA, 601 bp, Homo sapiens
  misc_feature: GZ8MTXP02GZIIH.21.35.D02.1.454.CMB.2.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (377)..(377): a, c, t, g, unknown or other
  misc_feature (377)..(377): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcactgggtccnccagactccaggcaaggggctagagtggctggcagttancgcagttcgatggaagcgtaatatgtactatgcggactcggtgaacggggcaattccacctatctaccagacgacaattaccaaagaaccncgtcttagtttcagactaaaatcgagtacagacctagaaaacgaagaacgacgacggactagtaatactaacgtgtacgacgacgtacgtacctttagttattagtacgggttacgaacggggtacctagttacgtacctacgggtacgggaccgtaacgggtaacccgtacggtaacccgtaccgttacccgttaccacgtaccgccccgtaccgaaacccgg

SEQ ID NO: 354946 - DNA, 743 bp, Homo sapiens
  misc_feature: GZ8MTXP02JOYDL.21.35.D02.1.454.CMB.2.raw
  modified_base (250)..(250): a, c, t, g, unknown or other
  misc_feature (250)..(250): n is a, c, g, or t
tcagtcgtcgctcgcacgaccggtgctcgatttagcacacgatagttgggtttggggggaagaggaagactgacggtcctgccacaggtggtgctgggcacggtgggcactagacacaacatttgcgctccactgtcaggtccacctggtggagtcggggggaggcgtgttccagcctgggactccctgagagtctcctgtgcagcctctggattcagcttcagtgtactttgccatgcacgtgggtccnccagactccgaggcgaaggggctaggagtggctggctagttatcgctattcgatggaagcgtatagtgtactagtcggcggtactccggtaggaaacggaccgtaccttccaacccgtatccctaccgaaggaacgtaacctaaacgtttacccgaaaagaaacccgtacgtacgtttcgttttaccgtaacgtaacctaaaaacgttggaaacggtaccgaaacggtacccgttaaagggaaaaaacgggaaaacggggaacgggaaacccgtaaccggggtacttaaggttaaattaacgttaaaacgttgggtaccgggaccggtaaccggtaaacggttaacccttttaaagtttaacgtttagtttagggttaccgaacggggtaacccttagtttacggaaccgtaacgggtcggggacccgtaacggggtaccccttagggtccctaccggtcctacccgtccgaccgtaccctacccgaacccgg

SEQ ID NO: 354947 - DNA, 588 bp, Homo sapiens
  misc_feature: GZ8MTXP02JH7BM.21.35.D02.1.454.CMB.2.raw
  modified_base (250)..(250): a, c, t, g, unknown or other
  misc_feature (250)..(250): n is a, c, g, or t
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (348)..(348): a, c, t, g, unknown or other
  misc_feature (348)..(348): n is a, c, g, or t
  modified_base (350)..(351): a, c, t, g, unknown or other
  misc_feature (350)..(351): n is a, c, g, or t
  modified_base (359)..(359): a, c, t, g, unknown or other
  misc_feature (359)..(359): n is a, c, g, or t
  modified_base (362)..(362): a, c, t, g, unknown or other
  misc_feature (362)..(362): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (380)..(380): a, c, t, g, unknown or other
  misc_feature (380)..(380): n is a, c, g, or t
  modified_base (401)..(401): a, c, t, g, unknown or other
  misc_feature (401)..(401): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcacgtgggtccnccagactccaggcaaggggctagagtggctggcagttatcgcatttcgatggaagcgatatgtactatgcggactcggtgaaggccatcacntcncanannatccaaanacncntgttcngacaaatgancagcagaaagagagacacggntagtaatataactgtagcgacgaacggtacctttaagttaatttagtacggttacaacggggtaacctagtttcggaaaccgttaacggtacgggggtacccgtaaacgggggtaaaccccgttaggggtaacccctaacccggttccgtaccccgttcgaaccggtccccttacccgaaacccggg

SEQ ID NO: 354948 - DNA, 660 bp, Homo sapiens
  misc_feature: GZ8MTXP02JC147.21.35.D02.1.454.CMB.2.raw
  modified_base (253)..(253): a, c, t, g, unknown or other
  misc_feature (253)..(253): n is a, c, g, or t
  modified_base (633)..(633): a, c, t, g, unknown or other
  misc_feature (633)..(633): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcgggggaggcgtgttccagcctgggacgtccctgagagtctcctgtgcagcctcgtggattcagcttcagtgtactttgccatgcacgtcgggcccnccagacctccgaggacgaaggggctaggagtggcgtggctagttatcgactagttcgagtgggaagcgtaattacgtgtaactagtggccggtacctcggtaggaacgggccgtaccttaccgaacctactcctaccgaaggaacactaaacttaacccgaaagtaaccaccgtctttcgtttactacgaacctaaagtaggacgacaacgtaccaagggaaaagaacggaaggacgacggtactagttaaataacgtacgtggtacgacgacggtacgttaacctttattaacgttagtacggttacgaacgggtaacctagttacgtaccggtacgaaccgggtccgaaacggtacccgtgtaacccgtaccgttccncctacgacctaccccgtaccaacccgg

SEQ ID NO: 354949 - DNA, 680 bp, Homo sapiens
  misc_feature: GZ8MTXP02F6I02.21.35.D02.1.454.CMB.2.raw
  modified_base (249)..(249): a, c, t, g, unknown or other
  misc_feature (249)..(249): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccncagactccaggcaaggggctagagtggctggcagttatcgcattcgatggaagcgatagtgtactagtcggcggtactccggtagaaacggggcctatttccacctattcctaccaaggacgactaaacttacccgaaaagaaacccacggtactttgttttaccagtaaccaaaagttgaacgcaaacgtaccgtaaggaaaagaacggaacgggaaccacgggtactaggttaaataacgttaaacgtggtacggacgtacggtaacggttaaacctttattaaacgttagttacgggttacgaaacgggtacctaggttacgtaaccgttacggcgggggtaacccgtaacggggtaaccccgttagggtaacccgtaacccggttccttaccccgtacgaccggtaccccttaccggaaaaccccgg

SEQ ID NO: 354950 - DNA, 612 bp, Homo sapiens
  misc_feature: GZ8MTXP02HIVBH.21.35.D02.1.454.CMB.2.raw
  modified_base (249)..(249): a, c, t, g, unknown or other
  misc_feature (249)..(249): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtccnccagactccgaggcgaaggggctaggagtggctggctagttatcgctattcgatggaagcgaatatgtactagtgacggtactccgtagaacgggccattcaccatctcaaganactaataccaaagaaccncgtcttgtttcagacaaatgagacagacctagaaaacgaagaggacacggactagtaataagtaacgtggtacggacgacgtaacggtaacctttaatttaagttagttacggttacgaacggggtacctaagttcggtaacttacggtacgggggaccctaaacggggtacccctagggtaacccgtacccggttacctcccgtacgaccgtacccgtacccaaacccgg

SEQ ID NO: 354951 - DNA, 683 bp, Homo sapiens
  misc_feature: GZ8MTXP02GVCTM.21.35.D02.1.454.CMB.2.raw
  modified_base (248)..(248): a, c, t, g, unknown or other
  misc_feature (248)..(248): n is a, c, g, or t
  modified_base (289)..(289): a, c, t, g, unknown or other
  misc_feature (289)..(289): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagacctccgaggcgaagggctagagtggctggcagttancgctagttcgagtggaagcgaatatgtaactatggccggtactccggtaggaaacgggccattccacctatcctaccgagacgactaaacttccgaaaagaacctacgtctttagtttaccagactaaaagtcgaacgcaacggtacccgtaaaggaaaaggaacggaaggaaccgtacgggtacttagtaaattaacgtaaacgttggtacggaccggtaacggtaacggttaaccttttaagttaacgtttaaggttcgggtttacaaacggggtaccttaaggtttacggaacccgttaaacgggttccgggggaaccctaacggggtaaccccttggggtaaccctacccgttcctaccgtacgacccgtcccgtaacccgaaacccggg

SEQ ID NO: 354952 - DNA, 672 bp, Homo sapiens
  misc_feature: GZ8MTXP02J41ZV.21.35.D02.1.454.CMB.2.raw
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (305)..(305): a, c, t, g, unknown or other
  misc_feature (305)..(305): n is a, c, g, or t
  modified_base (345)..(345): a, c, t, g, unknown or other
  misc_feature (345)..(345): n is a, c, g, or t
  modified_base (377)..(377): a, c, t, g, unknown or other
  misc_feature (377)..(377): n is a, c, g, or t
  modified_base (396)..(396): a, c, t, g, unknown or other
  misc_feature (396)..(396): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggaccgtccctgagagtctcctgtgcagcctctggattcagcttcagtgactttgccatgcactgggtccgcagactccaggcaaggggctagagtggctggcagttancgnattcgatggagcgatntagtactatgcggtactccgtgaaggggccaattccaccncatcaccagctaactaaacgtcccaaagaccngtcttgtttccagacaaanggacgaatacgacctaaggaaaacggacgaaaggtacgacggtaacttacggattactaacgtggtcgaccggtacggtaacggttacctttaaaagtttagttaaacgtttcgggttaaaaccgttacggggtaaaccttacgggttaaccgtaaaaccggttcgggtaacccggtttaaccgggggacccggtaaacccgggttaacccggttcccgtaaccccggttcccgttaacccccgtcccgtttaaaccctacccccggtaacccccg

SEQ ID NO: 354953 - DNA, 566 bp, Homo sapiens
  misc_feature: GZ8MTXP02H7JPG.21.35.D02.1.454.CMB.2.raw
  modified_base (200)..(200): a, c, t, g, unknown or other
  misc_feature (200)..(200): n is a, c, g, or t
  modified_base (246)..(246): a, c, t, g, unknown or other
  misc_feature (246)..(246): n is a, c, g, or t
  modified_base (284)..(284): a, c, t, g, unknown or other
  misc_feature (284)..(284): n is a, c, g, or t
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
  modified_base (374)..(374): a, c, t, g, unknown or other
  misc_feature (374)..(374): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtncagcctctggattcagcttcagtgactttgccatgcactgggtccncagactcaggcaaggggctagatggctggcagtttacncgctatcgagtggaangatatgtatatgacggactcgtagacggcactcactnctacgagacactaactacaaagacacgtctattctanacaanaganacacgactagaaagaagagacgacgatagtaataataagtagtacgacgacgaacgtaacttaacgttaagttagttacgttacgtaacggtaacgtacgttacgtacgtacggtacggaccggacggtaaccgtacgtaaccgtaccgtaccgtaccgtaccgaccgtaccgtaccgtaccg

SEQ ID NO: 354954 - DNA, 574 bp, Homo sapiens
  misc_feature: GZ8MTXP02H43T0.21.35.D02.1.454.CMB.2.raw
  modified_base (248)..(248): a, c, t, g, unknown or other
  misc_feature (248)..(248): n is a, c, g, or t
  modified_base (390)..(390): a, c, t, g, unknown or other
  misc_feature (390)..(390): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacattttgcgctccactgtcaggtccacctggtggagtcgggggaggcgtgttccagcctgggacgtccctgagagtctcctgtgcagcctctggattcagcttcagtgactttgccatgcactgggtccnccagacctccaggcaaggggctagagtggctggcagttatcgcattcgatggaagcgatatgtactagtgcggactccggtagaacggggccgattccaccatcctaccagacacaaacttccaaagaacacgtctgtttcngacaaatgagcagctagaaagaagagacacggctagtataataacgtgtgacgacgaggtacctttatagtttagtggtttacgaagggtacctagttacgactacggtacggggtccgaacggggtaaccctggtaacccgtacccggttacctcccgtacacggtaccctacccgaacccgg

SEQ ID NO: 354955 - DNA, 528 bp, Homo sapiens
  misc_feature: GZ8MTXP02JQC45.21.35.D02.1.454.CMB.2.raw
  modified_base (248)..(248): a, c, t, g, unknown or other
  misc_feature (248)..(248): n is a, c, g, or t
  modified_base (287)..(287): a, c, t, g, unknown or other
  misc_feature (287)..(287): n is a, c, g, or t
  modified_base (302)..(302): a, c, t, g, unknown or other
  misc_feature (302)..(302): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttancgcattcgatggaancgatatgtactatgcggactccgtagaaggaccgattccaccatcctccagacgacaattcccaaagaaccacgcttagtttcctagacaaaatgagcagcctagaaaagaagaggacacggactagtaatataactgtagcgacgagtaccttattatagtgttacaggtacattgactagtcgggccacggaccctggccaccgtctcctcacgcctacaaccg

SEQ ID NO: 354956 - DNA, 620 bp, Homo sapiens
  misc_feature: GZ8MTXP02HZ9DI.21.35.D02.1.454.CMB.2.raw
  modified_base (251)..(251): a, c, t, g, unknown or other
  misc_feature (251)..(251): n is a, c, g, or t
  modified_base (430)..(430): a, c, t, g, unknown or other
  misc_feature (430)..(430): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgcctatgctacgtgggtccnccagacctccgaggacgaaggggctaggagtgggctggctagttactcgctagttcgagtggaagcgtatagtgtactagtggacggtactccggtaggaacgggcctacttaccaacgtactacctacgaagaacgtactaaacttaccgaaaagtaaccgtacgtcttagtttaccngtaactaaagtcgaagcagtactaagaaagaaggaacgacgacggtactagtaataagtaactggtagacgtagtaacgtactttaattagttagttacggtacgaggtacctagttacgacgtacggtacgggaccgacggtaccgtggtaacccgtacgtctacctacgaccgtccctaaccgaccgg

SEQ ID NO: 354957 - DNA, 635 bp, Homo sapiens
  misc_feature: GZ8MTXP02FP9Q4.21.35.D02.1.454.CMB.2.raw
  modified_base (290)..(290): a, c, t, g, unknown or other
  misc_feature (290)..(290): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtcccgccagactccaggcaaggggctagagtggctggcagttancganattcgataggaagcgatatgtaactatggcggactccggtaggaaacggggccgtaattccaacccgatccctaccgaagaacgacctaaacttacccgaaaagaaaccgtaccgtcgtttacgtttactagactaaagtgaacgctacgaccgtagaaaagaagacggaacacggtactagtaaataacgtaagtcgtacggacgtacggtaacggtactttaagttaagttattagggttacgaacggtactagttacggacgtacggtacggggaccgaaccgggtaccgtacggccgtaacccgttctaccgtcaacggtcccctaccgaaacccgg

SEQ ID NO: 354958 - DNA, 723 bp, Homo sapiens
  misc_feature: GZ8MTXP02FVG0G.21.35.D02.1.454.CMB.2.raw
  modified_base (249)..(249): a, c, t, g, unknown or other
  misc_feature (249)..(249): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtgggtccnccagactccgaggcaaggggctagagtggctggcagttatcgctattcgatggaagcgtatagtgtactagtggacggtactcggtagaaacggggcctaattccaacctatcctaccgaaggacgactaattccgaaagaaccacgtcttagtttctagactaaaagtgaacgtcacgtaccgtaaggaaaaggaagaacgggaaaccgacgggtacttaaggttaaattaaacgttaaaccgttgggttacggaccggtaaccggtaacggttaaaccctttaaagttttaaacgtttaaggttacgggttttaaccgaacgggggttaacccttaaaggtttacggtaaaccgttaacgggtaccgggggtaacccgtaaaccggggtaaccccgttacggggtaacccgtaaccccggttcccgtaccccttaccggaacccgtaccccgttaaccccgtaaaacccggg

SEQ ID NO: 354959 - DNA, 603 bp, Homo sapiens
  misc_feature: GZ8MTXP02JLYSJ.21.35.D02.1.454.CMB.2.raw
  modified_base (247)..(247): a, c, t, g, unknown or other
  misc_feature (247)..(247): n is a, c, g, or t
  modified_base (286)..(286): a, c, t, g, unknown or other
  misc_feature (286)..(286): n is a, c, g, or t
  modified_base (309)..(309): a, c, t, g, unknown or other
  misc_feature (309)..(309): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccncagactccaggcaaggggctagagtggctggcagttacncgctattcgagtggaagcgaatntgtactagtcgcggtactccgtagaaacggtaccgattccaacctattcctaccgaagaacgacctaaacttacccgaaaaggaaacctacgtctttagtttacagactaaaagtgacgcaagacctaaggaaaagaacgagacgacggtactagtataagtaacgtgtcgacgacgtacgtactttaagttacttagtggtacaggtacctagttcgaactacggtacgggaccaacggggtaaccctggtaacccgaccgttcctcctacgaccgtaccctaccgaacccgg

SEQ ID NO: 354960 - DNA, 698 bp, Homo sapiens
  misc_feature: GZ8MTXP02HPHLX.21.35.D02.1.454.CMB.2.raw
  modified_base (252)..(252): a, c, t, g, unknown or other
  misc_feature (252)..(252): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgcctatgcacgtcgggtcccnccagacctccgaggacgaaggggctaggagtcggcgtggctagttactcgctagttcgagtggaagcgattagtgtactagtcggacggtacgtccgtaggaacgggcctacgtccaccgtatccgtacgaagacgacctaaacttaccgaaaacgacctacgtcgtttagttcctagacctaaaagtcgaacgctaacgtaccgtaaagaaaacgaaaggaacgggtaaccgacgggtacttagttaaattaacgttaagtacggtacgggacgtaacggtaacggtaacctttaagtttaagtttacggttaggttacgacgggtaaccttaggttaccgaaacgttacgggtacgggaacccgtaacggggttaaccccgtcgggttaaccctaacccggtccgttacccgtaccgaccccgtacccgtaccccgaaacccgg

SEQ ID NO: 354961 - DNA, 767 bp, Homo sapiens
  misc_feature: GZ8MTXP02JMJB4.21.35.D02.1.454.CMB.2.raw
  modified_base (255)..(255): a, c, t, g, unknown or other
  misc_feature (255)..(255): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcatgtgcagcctctggattcagtcttcagtgtactttgccctatgcacgttcgggtcccnccagacctccgaggcgaaggggctagagtgctggctagtatcgctagttcgagtggaagcgtaatatagtaactagtggaccggtactcggtagggaacggtccccgtaattccaacctacttaccaccgaagacgtaacctaaacttaccgaaaagaaccacggtctttacgtttacagaaacctaaaagtgaactaccaaacggtacccgtaaaggaaaaaacggacgggaaacgggaacccgtaacggggaacctttaaagggttaaacttaaccgttaaaaggtttcgggtaaccggaccgggtaaccgggttaaaccgggtttaaaccctttaaagtttttaaccggttaaggttagggttaccccggtaaaaggggtacccttaggtaccggtaaaccgttacgggttacccgggggaaccgttaaacgggggtaacccccgttgggttaacccccgtaaccgtccgtttaccccgacgtaaccccggtacccctaaacccccggg

SEQ ID NO: 354962 - DNA, 796 bp, Homo sapiens
  misc_feature: GZ8MTXP02F4OCA.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtcgggtccgcagactccgaggcgaaggggctagagtggcgtggctagttactcgcatttcgagtaggaagcgtatatgtaactagtcggaccggtaccgtccggtaggaaaccggggtcccgtaacgtttacccaacccgtaacttccgtacccgaaaggtaacgtaacctaaacgtttaacccccgaaaaagtaaacccgtaaccggttaccgtttacggttttaccgtacggtaaacctaaaaagttcggaacgtaccgaacgtacccgtaaaggaaaaacgggaaacggaacgggaaaccgtaaccgggtacttaaggttaaacttaaacgtaaacgttcggtacgggtaccggaaccggtaacggttaaaccttttaagtttaaacgttaggttacgggttacggaacggggtaaccctagtttacggtaaccgttaaaccgggtacgggggtaacccggtaaaccggggtaaacccgttccgggtaacccgttacccggttaccttaccccgtaccgtaacccggtacccctaacccgaaaaccccgggg

SEQ ID NO: 354963 - DNA, 559 bp, Homo sapiens
  misc_feature: GZ8MTXP02HXHJL.21.35.D02.1.454.CMB.2.raw
  modified_base (248)..(248): a, c, t, g, unknown or other
  misc_feature (248)..(248): n is a, c, g, or t
  modified_base (351)..(351): a, c, t, g, unknown or other
  misc_feature (351)..(351): n is a, c, g, or t
  modified_base (376)..(376): a, c, t, g, unknown or other
  misc_feature (376)..(376): n is a, c, g, or t
  modified_base (414)..(414): a, c, t, g, unknown or other
  misc_feature (414)..(414): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagactccaggcaaggggctagagtggctggctagttatcgctattcgagtggaagcgatatgtactatgcgactcgtagacggcattcaccatcctcaganactaattacccaaagaccacgcttntttctgactaaatgagcagctagaaagagagacacggntagtatataacgtgtagcgagagtactttatattagtagttcaagggtacctagttagacgttacggtacgggaccgaaccgggtaacccgtggtaacccgtacccggttacctcccgtacgtacccgtccctacccgaacccgg

SEQ ID NO: 354964 - DNA, 618 bp, Homo sapiens
  misc_feature: GZ8MTXP02GFOOA.21.35.D02.1.454.CMB.2.raw
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (348)..(348): a, c, t, g, unknown or other
  misc_feature (348)..(348): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagtgactttgccatgcacgtgggtccgccagactccgaggcaaggggctagagtggctggctagtancgcattcgatggancgatatgtactatgcggactccgagaacggccatccactatccncagagacaacttaccaaagaaccacgtctttgtttctagactaaagtgaagcagaccgtagaaaacgaaggaagggacacggacgttagtaataataacgtggtcgacgacggaaggttacctttagtttaacgttagtcggttacgaggtaaaccctagttacggaacgttacggtacgggggtaccgtaaaccgggggtaacccgttacgggtaacccgtaacccgtccgttacccgtaccgaccggtacccctaacccgaaacccgg

SEQ ID NO: 354965 - DNA, 715 bp, Homo sapiens
  misc_feature: GZ8MTXP02G8H1M.21.35.D02.1.454.CMB.2.raw
  modified_base (260)..(260): a, c, t, g, unknown or other
  misc_feature (260)..(260): n is a, c, g, or t
  modified_base (378)..(378): a, c, t, g, unknown or other
  misc_feature (378)..(378): n is a, c, g, or t
tcagtcgtcgctcgcacgaccggtgctcgatttagcacacgatagttgggtttggggggagaggagcccagcactggaagtcgccggtgtttccattcggtgatcagcactgaacacagaggactcaccatggagtttgggctgaccttgggttttcctcgttgcttcttttaagaggtgtccactgtcaggtccacgtggtggaggtcgggggagcgtgttccagcctgggacgtcctgagagtctcctgtgcagcctntggattcagtcttcagtgactttgcctatcgcacgtcgggtcccaccagtacctccgaggaccgaaaggggctaggagtcggcgttggctagttatcggactagttccgatgggaaancgtaattgtagtactagtcggaccggtaccgttccggtaggaaacgggtcccgaattccaacccgtatccgtaccgaagacgaacctaaacttacccaaaagtaaccgtacgtacttggtttaccagtaacaaaagttggaacgtaccgtaacggtaacccgaaaggaaaaaggaaacgggaacggaaaaccgtaccggggtacttaaaagggttaaatttaaaacggtaaacgtttcggggtaacgaccggtaacgggtaaaaccggttaaacccgttttaaattaagttttaaccggtaagggtttaccggaaaacggggttaaaccctttaagg

SEQ ID NO: 354966 - DNA, 668 bp, Homo sapiens
  misc_feature: GZ8MTXP02HRDPH.21.35.D02.1.454.CMB.2.raw
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
tcagtcgtcgctcgcacgaccggtgctcgatttagcacacgatagttgggtttggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcggggggagcgtgttccagcctgggacgtccctgagagtctcctgtgcagcctctggattcagcttcagtnactttgccatcgccacgtcgggtccnccagacctccgaggcgaaaggggctaaggaggtggcgtaggctagttactcgctagtttcccgaagttgggaacgcggtaattagtaggttaccttaggtcggaccggtaccgttcccgggtaggaaaacggggtccccgtattacccgaacctactccctaccgaaacgtacgaactaaacttacccgaaacgaaccacgtaccttgtttacctagactaaagtcgaagacaacgaccgtaagaaacggaaagacggaacgacggtactaggttaataacgtaacgtacggtagaccggacggtaacggttaaccctttaagtttaacgtttaggttacggtttacgtaacggggtaccttaagg

SEQ ID NO: 354967 - DNA, 801 bp, Homo sapiens
  misc_feature: GZ8MTXP02JJ65A.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggaggtcgggggagcgtgttccagcctgggacgtccctgagagtctcctgtgcagcctctggattcagtcttcagtgactttgccatgcacgtgggtcccgccagacctccgaggcgaaaggggctaggaggtggcgtggctagttagcgactattcgagtaggaagcgtaatagtgtactagtggaccggtactaccggtaggaaccggggtcctaacttcccgaacctatacccgtaccaaggtaacgtaaccaaacgtttacccgaaaaggtaaaccctaccggttactttacggtttacctacgaaccgtaaaagtggaacgacgaacggtacccgtaaaaggaaaaggaaacgggaacgggtaaaccgtaacggggttaaacttaacggttaaacttaaacgttaaaccgttagggtaccgggaaccgggtaccggtaaaccgggttaacccgttttaaagtttaacggtttaacggtttaggggttaaccggtaaggggttaaaaccccttaggtttaccggtaaaccggttaccgggttaccgggggaaccccggtaaaaccggggttaacccccgtagggtaaccccgttaaccccggttaccttaccccgtacctacccggtaccccctaccgaaacccccgg

SEQ ID NO: 354968 - DNA, 697 bp, Homo sapiens
  misc_feature: GZ8MTXP02H54E7.21.35.D02.1.454.CMB.2.raw
  modified_base (247)..(247): a, c, t, g, unknown or other
  misc_feature (247)..(247): n is a, c, g, or t
  modified_base (289)..(289): a, c, t, g, unknown or other
  misc_feature (289)..(289): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtcctgagagtctcctgtgcagcctctggattcagcttcagtgactttgccatgcacgtgggtccnccagactccgaggcgaagggctaggagtggctggcagttacncgctagttcgagtggaagcgatatgtaactagtcggcgactccgagtcgggaacgggtcccctattccgaacctattcctaccgaaggacgtaaactaaaacttacccgaaaagtaaccgacgtctttcgtttaccagaaacaaagtcggaagccagtacctaaggaaaaagaacgggacgaaccgtaacggtcgttaaagttaaattaaacgtaaacgttgggacgacgggtaacggtaaacggttaacctttaagtttaaactttggtacgggttaacgtaacggggtaccttaaggtttacgaaaccggtttacggacgggggacccgtaaacggggtaaaccccgttggggtaacccctaaccggttccctaacccgtccgtaaccggtaccccctaaccccgg

SEQ ID NO: 354969 - DNA, 797 bp, Homo sapiens
  misc_feature: GZ8MTXP02HG0WD.21.35.D02.1.454.CMB.2.raw
  modified_base (250)..(250): a, c, t, g, unknown or other
  misc_feature (250)..(250): n is a, c, g, or t
  modified_base (296)..(296): a, c, t, g, unknown or other
  misc_feature (296)..(296): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtcccnccaggacctccgaggcgaaggggctaggagtggctggacaggttancgactagttcgagtggaagcgatatgtactagtcgcggtactccggtaggaacgggtccgtaactttcccgacctacgttacccgtacccgaaggaacgtaaccttaaaccgttaccgaaaacggtaaaacccgtaccggttacctttacggtttttacccgtaggaaaccctaaaaggttcgaacggtacccgaaacgtacccgtaaaaggaaaaggaaacgggaacgggaaacccgaaccgggtacgtttaaggttaaattaacggtttaaacctggggttacggaccgggtaccggtaaacggttaaccttttattttaaaggttacgtttacggggttaaccgtaaacgggggttaaccctaagggtttacggtaaacccggttaacggggttacgggggacccgtaaaccgggggttaaccccggttggtaaccccgtaccccgggttccttaccccgtaccgtacccgtacccccgttaacccggaaaccccggg

SEQ ID NO: 354970 - DNA, 563 bp, Homo sapiens
  misc_feature: GZ8MTXP02IMR7D.21.35.D02.1.454.CMB.2.raw
  modified_base (247)..(247): a, c, t, g, unknown or other
  misc_feature (247)..(247): n is a, c, g, or t
  modified_base (283)..(283): a, c, t, g, unknown or other
  misc_feature (283)..(283): n is a, c, g, or t
  modified_base (299)..(299): a, c, t, g, unknown or other
  misc_feature (299)..(299): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccncagactccaggcagggctagagtggctggcagttancgctattcgatggaancgatatgtactatgcggactcgtgaacggcatcacatctcagacgactaattaccaaagaccncgtntgtttcagacaaatgacgacagacctaggaaaagacggaaggacacgatagtaaatacgtactgtagacgacgacgtacttattatagttcgtgacgggtactagttcgaacgttacggcggggtaccgaaacgggtacccttacgggtcctacccggttcctacccgtacgaaccgtccctaacccgaaaccccgg

SEQ ID NO: 354971 - DNA, 870 bp, Homo sapiens
  misc_feature: GZ8MTXP02F7KP2.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagtgtactttgccatgcacgtcgggtcccgccagacctccgaggcgaaggggctaggagtggctggctagttacgcgatagttcgagtagggaacgtgtaaagttagttgttaacttagtcgggacccggtaccgtccggggtagggaaaccggggtccgtaacctttacccgaacccgtaacttccccgtacccgaaggtaaaccgtaccttaaaaccgttaaccccgaaaaacggtaaaccctccgggttacgttttacgggtttttaccctaaacggaaacctaaaagttcggaaacggacctaaacgggtacccgtaaaagggaaaaagggaaacggacgggaaaccgtacgggtaaaccgtttaggttaaaaccgttaaagttaacggtttacgggtaccggaccgggtaaacccggttaaacgggtttaaccttttaaagtttttaaagttaccgggtttagggtttaaacccgggaaacggggttaaacccttaggtttaaccggaacgggtttaaacccggggaaccgggggttaccccggaaaaccgggggttaaccccggtttacgggtaaccccgtaacccccggtttcggtaccccttaccggaaccccgttaccccgtaaccccggaaacccggg

SEQ ID NO: 354972 - DNA, 580 bp, Homo sapiens
  misc_feature: GZ8MTXP02G0K59.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgagtggaagcgaatatgtactatcgcggtactccgtaggaacgggcctaattccacctatcctaccaagacgaccaaattcccaaaagaaccacgtctttgttctagacaaatgaagacagacctagaaaagaagagaacacggacttagtaataataacgtgtacggacgacgtaagtaacctttaattaagttataggttacgaagggtacctagttacgacgttacggcgggaccgaccggtaccgtacgtcgacccgtctcctaccacgaccctaccaaccg

SEQ ID NO: 354973 - DNA, 713 bp, Homo sapiens
  misc_feature: GZ8MTXP02GMLOC.21.35.D02.1.454.CMB.2.raw
  modified_base (250)..(250): a, c, t, g, unknown or other
  misc_feature (250)..(250): n is a, c, g, or t
tcagtcgtcgctcgcacgaccggtgctcgatttagcacacgatagttgggtttggggggaagaggaagactgacggtcctgccacaggtggtgctgggcgcggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtcgggtccnccagacctccgaggcgaaggggctagagtggctggctagttatcgctattcgatggaagcgatagtgtactatggacggtactccggtaggaacggggtcctattccgaacctagtcctaccgaaggaacgtacctaaacttaacccgaaaaggtaaccctaccgtacgtttacgtttaccgtacgaaactaaaagtgaacgacgaacgtaccgtaaggaaaaggaaacggaacgggaaccgaacgggtacttaggttaaacttaacgttaaacgttggtacgggtaccggaacggtaacgggtttaaccctttaaagtttaaagtttacgttaacgggttacgaacggggttaaccctagttacggtaccgttaacgggtcgggaccggtaaacgggtaccccgtacgggtaaccgtacccgttaccgttaccctacggaccgtaccctacccgaaacccgg

SEQ ID NO: 354974 - DNA, 578 bp, Homo sapiens
  misc_feature: GZ8MTXP02F0CC3.21.35.D02.1.454.CMB.2.raw
  modified_base (343)..(343): a, c, t, g, unknown or other
  misc_feature (343)..(343): n is a, c, g, or t
  modified_base (348)..(348): a, c, t, g, unknown or other
  misc_feature (348)..(348): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtccgccagactccgaggcaaggggctagagtggctggcagttatcgcattcgatggaagcgatagtgtactatgcgactcgtgaaggcatcaccatcncaganactaactcaaagaacacgcttgttcagactaaatgaagtacagaccgtaagaaaagaagacggaacacggtacttagtaaattaactaaacgtggttacgacgacggtaggtaacctttagtttaaattagtacggttacgaaggtacctagttagactacgggtcggggaccgtaaacgggacccgttggaaccgtacccgtctacccgctacgccctaccgaaaccgg

SEQ ID NO: 354975 - DNA, 765 bp, Homo sapiens
  misc_feature: GZ8MTXP02IF0L6.21.35.D02.1.454.CMB.2.raw
  modified_base (291)..(291): a, c, t, g, unknown or other
  misc_feature (291)..(291): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtcccgccagacctccaggcaaggggctagagtggctggctagttancgctagttcgatggaagcgaatatgtactagtgacggactccggtaggaacgggccgtattaccacctatcctaccaagagacctaaattacccgaaaacgaacctaccgtctttacgtttaccgtagaactaaaagtggaacgtaccaaagtacccgttaaagggaaaaacggaaagggaaacgggaaacccgaaccgggtaccgtttagggtttaaaacttaaacgtttaaaaccgttgggttacgggaccggtacgggtaaaacgggttaaccccttttaaagttttaaacgtttaaggttacgggtttacccggaaaagggggtaaccccttaaaggtttaccggtaaaccgtttaaaccgggtacgggggtaccccgaaaccgggggttaaacccccgtggggtaaccctaaccccgggttacccttaccccgttaccgacccggtaccccttaccccgaaaaccccgg

SEQ ID NO: 354976 - DNA, 546 bp, Homo sapiens
  misc_feature: GZ8MTXP02J0SF3.21.35.D02.1.454.CMB.2.raw
  modified_base (248)..(248): a, c, t, g, unknown or other
  misc_feature (248)..(248): n is a, c, g, or t
  modified_base (288)..(288): a, c, t, g, unknown or other
  misc_feature (288)..(288): n is a, c, g, or t
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccgaggcaaggggctagagtggctggcagttancgcattcgatggaagcgatatgtactatgcggactccgtgaacgggccattccaccatcctccagacgacaattccaaagaacacgcttgtttcngacaaatgancagctagaaagagacgacacggctagtaatataactgtacgcgacgaggtaccttagttattagttggttacgacgggtacctagttcgacttacggtcggggaccacggggaaccctggtccaccgtctcctacacgtccctaccaacccgg

SEQ ID NO: 354977 - DNA, 544 bp, Homo sapiens
  misc_feature: GZ8MTXP02IZDA9.21.35.D02.1.454.CMB.2.raw
  modified_base (248)..(248): a, c, t, g, unknown or other
  misc_feature (248)..(248): n is a, c, g, or t
  modified_base (348)..(348): a, c, t, g, unknown or other
  misc_feature (348)..(348): n is a, c, g, or t
  modified_base (381)..(381): a, c, t, g, unknown or other
  misc_feature (381)..(381): n is a, c, g, or t
  modified_base (525)..(525): a, c, t, g, unknown or other
  misc_feature (525)..(525): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggactccgtgaaggccgattcaccatctcanacgacaattaccaaagaaccacgtcttgtttcngacaaatgagcagctagaaagaagaggacacggactagtaataataactgtacggcgtacgaggtacctttattaattagttaggtacacggtactattgacgtacgtacgggccgaacggaccgtcggtccgtaccgtctccncaccgccctaccgaacccg

SEQ ID NO: 354978 - DNA, 878 bp, Homo sapiens
  misc_feature: GZ8MTXP02FX2EM.21.35.D02.1.454.CMB.2.raw
  modified_base (251)..(251): a, c, t, g, unknown or other
  misc_feature (251)..(251): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgtactttgccatgcacgtgggtccnccagactccgaggcaaggggctagagtggctggctagttactcgctatttcgagtggaagcgtaatagtgtaactagtcggaccggtaacttccggtaggaaacggggtccctaagtttacccaaccctaagttcccttacccgaaaggtaaacgtaacctaaaacgtttacccccgaaaaaagggtaaacccctaaccgggttacttttacgggtttttacccgtaacggtaaaccctaaaaaacggttcgggtaaaaccggtaccgtaaaccgggtaaccccgttaaaggggaaaaaaacgggtaaaacggggtaaacggggaaaacccggtaaccgggggtacctttaaagggtttaaaactttaaaacggtttaaaaccggttgggttaaccggggaaccggtaacccggggttaaacgggttaaaccctttttaaagttttaaacggtttaaggtttacggggtttaacgaaaacgggggtaacccttaaggtttacggtaaaccgttaaccgggtacgggggtaaccccgtaaaccgggggtaaccccgttacggggtaacccgtaacccggttccttaccccgttaccgaaccggtcccccttaacccgaaaaccccggg

SEQ ID NO: 354979 - DNA, 594 bp, Homo sapiens
  misc_feature: GZ8MTXP02J41ZO.21.35.D02.1.454.CMB.2.raw
  modified_base (248)..(248): a, c, t, g, unknown or other
  misc_feature (248)..(248): n is a, c, g, or t
  modified_base (285)..(285): a, c, t, g, unknown or other
  misc_feature (285)..(285): n is a, c, g, or t
  modified_base (288)..(288): a, c, t, g, unknown or other
  misc_feature (288)..(288): n is a, c, g, or t
  modified_base (305)..(305): a, c, t, g, unknown or other
  misc_feature (305)..(305): n is a, c, g, or t
  modified_base (373)..(373): a, c, t, g, unknown or other
  misc_feature (373)..(373): n is a, c, g, or t
  modified_base (393)..(393): a, c, t, g, unknown or other
  misc_feature (393)..(393): n is a, c, g, or t
  modified_base (442)..(442): a, c, t, g, unknown or other
  misc_feature (442)..(442): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggaccgtccctgagagtctcctgtgcagcctctggattcagcttcagtgactttgccatgcactgggtccncagactcaggcaaggggctagagtggctggcagttancgnattcgatggaagcgatntgtactatgcgggacctcggtgaaacgggccattcacctcagtcacagataactaagtccaagtaccncgtacttgttcagactaagngacgactagacaagaaagacgagtaacgcgtattagtatacgttacggngtcgacggtacgttaacgttactttaagtttagtttacgtcggtaaacggtacgtactaggttacggtaaccggtacgggtaccggtaccggaccggtaccgttaaccgtacccgtaccgtcccgtaccctccgtaccgaccccgtaacccg

SEQ ID NO: 354980 - DNA, 672 bp, Homo sapiens
  misc_feature: GZ8MTXP02IAYFM.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtcccncagactccaggcgaaggggctagagtggctggcagttatcgctattcgatggaagcgatatgtactagtgcggactccgtagaagggccgattccgaaccatcctaccgagacgactaaattacccaaagaaccacgtcttagtttcagtacaaaagtgaagcaagtaccgtaagaaaagaaaggaacggacgaacgggtaccgttaagttaacgttaagttaaaccgtggtacggacgacggtaaacggtaacctttaagtttaactttaaggttacgggttaacgtaacgggtaaccctaggtttacgtaaacgttaaccgggttacgggggacccgtaaaccgggggtaaaccccgttcggggtaaccctaacccggttaccgttccctaccgaccggtacccctaacccgaaaccccggg

SEQ ID NO: 354981 - DNA, 624 bp, Homo sapiens
  misc_feature: GZ8MTXP02H8B1C.21.35.D02.1.454.CMB.2.raw
  modified_base (201)..(201): a, c, t, g, unknown or other
  misc_feature (201)..(201): n is a, c, g, or t
  modified_base (252)..(252): a, c, t, g, unknown or other
  misc_feature (252)..(252): n is a, c, g, or t
  modified_base (315)..(315): a, c, t, g, unknown or other
  misc_feature (315)..(315): n is a, c, g, or t
  modified_base (329)..(329): a, c, t, g, unknown or other
  misc_feature (329)..(329): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtncagcctcgtggattcagtcttcagtgtactttgccatgcacgtgggtcccnccagacctcgaggcgaaggggcaggagtggctggctagttactcgctagtttccgagtggaancgatatgtactagngcgactcgaggacggcactcacatctcagacgactaactacaaagaacctacgtctatttcagtaacaaatgatacgagtaccgtaaaggaaaaggaacgaaggtaccgaaggtacttaggtaaataaagttaaacgtggtacggaacgtacggtaaacggttaaccttttaattacgtttagtaggtttacggaacggtaacctagtttcgaaacgttcggtacggggaccgtaaccggggtacctcggtaacccgtaccgtaccttccaccgtaccgccctaccgaaacccgg

SEQ ID NO: 354982 - DNA, 756 bp, Homo sapiens
  misc_feature: GZ8MTXP02I55TL.21.35.D02.1.454.CMB.2.raw
  modified_base (295)..(295): a, c, t, g, unknown or other
  misc_feature (295)..(295): n is a, c, g, or t
  modified_base (317)..(317): a, c, t, g, unknown or other
  misc_feature (317)..(317): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgctacgtgggtcccgccagacctccgaggcgaaggggctaggagtggcgtggctagttancgctattcgatggaagcgaatntgtactagtcggcggtactccgtaggaacgggtcctacttccaccgtatccgtaccaaggaacgacctaaacttacccgaaaagtaaaccgtaccgtacgtttagttttacctacggaaccttaaaagtcggaaacgaccgtaacgtacccgtaagggaaaaaggaaacgggaacggacgaacgggtacgttaacgttaaagtaacgttaaacgtaggtacggtaccggtaacggtaaacggttaaccgtttaagtttaaagtttacgttacgggttaacgtaacggggtacccgttaaggtttacggtaacccgttaacggggtaccgggggtaaccccgtaaaccggggttaaacccccggttcgggtaacccgttaaccccggttcccgttaccccgttacccgtaacccggtccccctaaccccgtaaaccccgg

SEQ ID NO: 354983 - DNA, 629 bp, Homo sapiens
  misc_feature: GZ8MTXP02G59WN.21.35.D02.1.454.CMB.2.raw
  modified_base (302)..(302): a, c, t, g, unknown or other
  misc_feature (302)..(302): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggaggtcgggggagcgtgttccagcctgggacgtccctgagagtctcctgtgcagcctcgtggattcagcttcagtgactttgccatgcacgtgggtcccncagactccgaggcaaggggctagagtggctggctagttatcgctattccgatggaagcgtattatgtactagtcggaccggtactcgtagacggggtcctacttcgacctatcctacaagacaactaacttaccgaaagaccaacgtcttagtttcacgactaaaagtgaacgacgaacgtacccgtaaaggaaaacggaaggaacgggtaaccgaccggtactaggttaaactaacgttaaaccgtggttacggaccggtaacggtaaacggttcctttaaaagttagtttaacggtggtttaaccgaacggggtaacctttaagg

SEQ ID NO: 354984 - DNA, 698 bp, Homo sapiens
  misc_feature: GZ8MTXP02GT6H7.21.35.D02.1.454.CMB.2.raw
  modified_base (251)..(251): a, c, t, g, unknown or other
  misc_feature (251)..(251): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttcccagcctggggacgtcccctgagagtctcctgtgcagcctctggattcagcttcagtgactttgccatgcactgggtccnccagactccaggcaaggggctagagtggctggcagttacncgntattcgatggaagcgatatgtactagtcgcggtactccggtaggaacggggtccgtacttaccacctacttccgtaccgaaggaacgacctaaacgttacccaaaagtaaacccgacgttctttacggttttactacgtaacctaaaacgtcgaacgaccgtaacgtaccgtaaaggaaaaacggaaaggaacggaacgaacgggtactaaggttaaactaaacgttaaccgttggtacggaccggtacggtaacggttaacctttaagtttacgttaagttacggtttacgaacgggtaacctagttacgaccgttacggtacggggacccgtaaacgggtacccgttacggtaacccgtacccgttacctacccgtacctaccgtaccctaacccgaacccg

SEQ ID NO: 354985 - DNA, 639 bp, Homo sapiens
  misc_feature: GZ8MTXP02JP0I1.21.35.D02.1.454.CMB.2.raw
  modified_base (250)..(250): a, c, t, g, unknown or other
  misc_feature (250)..(250): n is a, c, g, or t
  modified_base (292)..(292): a, c, t, g, unknown or other
  misc_feature (292)..(292): n is a, c, g, or t
  modified_base (421)..(421): a, c, t, g, unknown or other
  misc_feature (421)..(421): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgacacgtgggtcccnccagacctccgaggcaaggggctagagtggctggctagttancgctagttcgatggaagtcgaatatgtaactagtcggcggactccgtaggaaacggggctacttcaccatcctaccgaagacactaacttaccaaagtaaccagtcttagtttacacgtaactaaaagngacgacacgtacgaagaaaagaacggacggacgacggtactagtaataacgtagtggtacggacgtacgtaacgttaactttaattaagttacgtacggtacgaacggtaacctagttacggacgttaacgggtacgggtaaccgtaaccgggtacccgtacggtaacccgtaccgttaccgtaccctacgtacccgtaccccgtacccgtaaaccgg

SEQ ID NO: 354986 - DNA, 626 bp, Homo sapiens
  misc_feature: GZ8MTXP02FQQF4.21.35.D02.1.454.CMB.2.raw
  modified_base (254)..(254): a, c, t, g, unknown or other
  misc_feature (254)..(254): n is a, c, g, or t
  modified_base (298)..(298): a, c, t, g, unknown or other
  misc_feature (298)..(298): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggaggtcgggggagcgtgttccagccgtgggacgtccctgagagtctcctgtgcagcctctggattcagtcttcagtgtactttgccatcgctacgtcgggtccncagacctcgaggcgaagggctaggagtggactggctaagttacncgctagttcggagtaggaagcgtaatatagtactagtcgaccgtaccgtcgtaggaaccggtactaccgttaccaacctactccgtaacgaagtaactacgtaactaaacccgaaagaaacctcgtactttacgtttacagtacaaagtcgaacgacagacgaaaggaaagaacggaacgtacgacgtacttagtaataacgtagtcgaggcgtacgtagtactttagttacgtagtagtacgacgtactagtacgaacgtcgggacggacggtacgtaaccgttcggaaccctacccgtctacccgacgtcacccgaacgaacccgg

SEQ ID NO: 354987 - DNA, 552 bp, Homo sapiens
  misc_feature: GZ8MTXP02JXSUZ.21.35.D02.1.454.CMB.2.raw
  modified_base (247)..(247): a, c, t, g, unknown or other
  misc_feature (247)..(247): n is a, c, g, or t
  modified_base (288)..(288): a, c, t, g, unknown or other
  misc_feature (288)..(288): n is a, c, g, or t
  modified_base (301)..(301): a, c, t, g, unknown or other
  misc_feature (301)..(301): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (371)..(371): a, c, t, g, unknown or other
  misc_feature (371)..(371): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtgctggcagttatcgnagttcgatggaancgatatgtactatgcgactcgtgaggcatcacatcncagancatacaagaacacgctagttcagacaaangagcagctagaaagagagacacggactagtaatataactgtcgagaccgtaggtacccttaagttaattagttaggttacgaacggggtacctagttacggaacgttacggcgggggaccgaacggggtaacccctggtaaccgacccggttcctaccgacgtacgcccgtaccaacccgg

SEQ ID NO: 354988 - DNA, 577 bp, Homo sapiens
  misc_feature: GZ8MTXP02HVBBZ.21.35.D02.1.454.CMB.2.raw
  modified_base (363)..(363): a, c, t, g, unknown or other
  misc_feature (363)..(363): n is a, c, g, or t
  modified_base (396)..(396): a, c, t, g, unknown or other
  misc_feature (396)..(396): n is a, c, g, or t
  modified_base (451)..(451): a, c, t, g, unknown or other
  misc_feature (451)..(451): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtcccgccagactcgaggcgaagggctagagtggctggcagttatcgctattcgagtggaagcgatatgtactagtggccggactccggtaggacgggcctacttcaccatctacaganactaataccaaagtaaccacgtctttgtttccngtacaaatgaagcaagacctaagaaagaagacggacacggctagtaatattaacngtgacgcggaagtacttagttattagtggttacagggtacctagttcgaacgtaggcggggacccgacgggtaacccctggtaaccctaccggttcctacccgtcaccgtccctaccgaaccccgg

SEQ ID NO: 354989 - DNA, 586 bp, Homo sapiens
  misc_feature: GZ8MTXP02HHAMF.21.35.D02.1.454.CMB.2.raw
  modified_base (246)..(246): a, c, t, g, unknown or other
  misc_feature (246)..(246): n is a, c, g, or t
  modified_base (285)..(285): a, c, t, g, unknown or other
  misc_feature (285)..(285): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagacctcaggcaaggggctagagtggctggcagttancgctattcgagtggaagcgatatgtactagtggacgtactccgtggaacgggtccacttccacctactcctaccaaggaacacaaactttacccaaagaaccaccgtctttgttttaccagtacaaagtcgagacagaccgtaagaaaagaaggacggaacacggtactagtaataattacgtagtgacgagtacgtacgttatagttagtagtacgaggtacctagttagacgtacgtcggggacgaacgggtaccttaggaaccgtaccgttctcctacgaccgtccctaccgaacccg

SEQ ID NO: 354990 - DNA, 523 bp, Homo sapiens
  misc_feature: GZ8MTXP02J2ITO.21.35.D02.1.454.CMB.2.raw
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
  modified_base (509)..(509): a, c, t, g, unknown or other
  misc_feature (509)..(509): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccncagactccaggcaaggggctagagtggctggcagttancgcattcgatggaagcgatatgtacagtgcggactcgtagaggccatcacatctcagagacaattccaaagacacgtcttgttcagtacaaatgagcagctagaaagagagacacggctagtatagtaacgtgtacgacgacgacgttaaccttagttatagttggtacgaggtaccagttcgacgttacgcgggaccacggtaaccctggccaccgtcacctnacgtcccacaaccg

SEQ ID NO: 354991 - DNA, 682 bp, Homo sapiens
  misc_feature: GZ8MTXP02FLKNP.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccgccagactccaggcaaggggctagagtggctggcagttatcgctagttcgagtaggaagcgtatatagtactagtcggccggtacgtccggtaggacgggtaccgtacttaccacctatcctaccgaagaacgtacctaaacgttaacccaaacgaaaccgtacgtcgtttcgtttacgtagaaacctaaagtcgaacgacgaaccgtacccgtaaaggaaaacggaaaggaccgggtaaaccgaccgggtacttaagtttaaattaacgttaaccgttgggtaccggacggtaccggtaacggttaaccttttaatttacgttaggttacggttacgaacgggtaacctagttacgtacgtacgggtcgggtaccgaccggtaccgttcggtaacccgtacccgtcctaccgctaccgcccctaccgaacccggg

SEQ ID NO: 354992 - DNA, 622 bp, Homo sapiens
  misc_feature: GZ8MTXP02FM9CR.21.35.D02.1.454.CMB.2.raw
  modified_base (250)..(250): a, c, t, g, unknown or other
  misc_feature (250)..(250): n is a, c, g, or t
  modified_base (290)..(290): a, c, t, g, unknown or other
  misc_feature (290)..(290): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtccnccagactccaggcgaaggggctagagtggctggcagttancgcattcgagtggaagcgtatatgtactagtgcggtactccggtggaaacgggccattccaccatcctaccagacactaacttaccaaaagaaccacgtcttcgtttctagactaaaatgaagcaagacctagaaaagaaggacggaacgacggtactagtaaataagtaacgtgtacggacgacggtaaggtacctttaatttaagttacgtaggttacgaacgggtaacctagttacgaacgttacggtacggggacccgtaacggggtaacccgttgggtaaccctacccgtaccttcccgtacgaccgtacccctacccgaaacccgg

SEQ ID NO: 354993 - DNA, 549 bp, Homo sapiens
  misc_feature: GZ8MTXP02GV16O.21.35.D02.1.454.CMB.2.raw
  modified_base (303)..(303): a, c, t, g, unknown or other
  misc_feature (303)..(303): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagactccaggcaaggggctagagtggctggcagttatcgcattcgatggaancgatatgtactatgcggactccgtagaaggggccattcaccatctcagagcaaattccaaagaacacgctgtttctgacaaaatgagcaagcctagaaaagaaagaagggacaacggactagtaataattaaactgtaggcgacgaggaccttaattaattatgttacagggacatttagaactacgtacggggaccaaggggaaccctgggtaacaccgtactcctacacgacctaccaaacccg

SEQ ID NO: 354994 - DNA, 636 bp, Homo sapiens
  misc_feature: GZ8MTXP02G0MON.21.35.D02.1.454.CMB.2.raw
  modified_base (248)..(248): a, c, t, g, unknown or other
  misc_feature (248)..(248): n is a, c, g, or t
  modified_base (284)..(284): a, c, t, g, unknown or other
  misc_feature (284)..(284): n is a, c, g, or t
  modified_base (301)..(301): a, c, t, g, unknown or other
  misc_feature (301)..(301): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccncagctcaggcaagggctagagtggctggcagttacncgctattcgagtggaancgatagtgtactagtggccggtactccggtgaaacggggcctagttccactactcctaccgaagacgacctaacttcccaaaaggaacctacgtctttagtttccagacaaatcgaagacgagaccgtaagaaagaaagagaacgacggtactagtaaatagtaacgtggtacgaccgtacggtaggtaccttagttaacgttacgttacgggttacgaacgggtacctagttacggtaacgttaccggtacggggtaccggaacggtaacccgttacggtaacgtaccccggttcgtacccgttaccgaccgtacccgtaaccgtaaaccccgg

SEQ ID NO: 354995 - DNA, 673 bp, Homo sapiens
  misc_feature: GZ8MTXP02IB2WY.21.35.D02.1.454.CMB.2.raw
  modified_base (249)..(249): a, c, t, g, unknown or other
  misc_feature (249)..(249): n is a, c, g, or t
  modified_base (286)..(286): a, c, t, g, unknown or other
  misc_feature (286)..(286): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccncagctcaggcaaggggctagagtggctggctagttancgactattacgagtaggaagcgaatagtgtactagtcggaccggtacgtccggtaggaaacggggcctattccgacctatccgtacccaaggaacgacctaaactttacccgaaaaggtaacccaccggttctttagttttacctagactaaaagtggaacgactagacccgtaaggaaaacgaaggaacggacgaccggtattagtaaactaagttaacgtggtacggaccgtacggaacggttaaccttttaagtttaactttaggttacggttacgacggggttaacctagtttacgaacgttacggacgggggaccgtaaacgggtacccgttacggtaaccgtacccggttactccctacgaccgtccctaccgaaacccgg

SEQ ID NO: 354996 - DNA, 637 bp, Homo sapiens
  misc_feature: GZ8MTXP02IRDZP.21.35.D02.1.454.CMB.2.raw
  modified_base (247)..(247): a, c, t, g, unknown or other
  misc_feature (247)..(247): n is a, c, g, or t
  modified_base (375)..(375): a, c, t, g, unknown or other
  misc_feature (375)..(375): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccncagacctcaggcaaggggctaggagtggctggcaggttatcgctattcgagtggaagcgatatgtactagtgcgtactcggtagacgggcatcactatctacagacactaacgttacaaagacacgtnttagtttcagacaaagtgagcgaacgactaaggaaaagaagaacgacgaacggtactaagttaataaagttaacgtagacggacgtacgtaacggtaactttaagttaagtttaaggtacggtttacgaaacggggtacctaaaggtttacggtaacgttaacggtacgggggtacccgtaaacggggtaaaccccgttcgggtaacccgtaacccggttccttacccgtaccgaaccggtccccttaacccgaaaccccgg

SEQ ID NO: 354997 - DNA, 602 bp, Homo sapiens
  misc_feature: GZ8MTXP02JFQZI.21.35.D02.1.454.CMB.2.raw
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
  modified_base (360)..(360): a, c, t, g, unknown or other
  misc_feature (360)..(360): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgccatgcactgggtcccncagacctcgaggcaaggggctagagtggctggctagttancgcattcgagtggaagcgatatgtactagtgcggactcgtggaacggccgattccacctatcctacagaanactaactaccaaagaaccacgtctttcgttctagacaaaagtgaacgcaacgtaccgaaggaaaaggaaggacggaacgacggtaacttagtaaattactaagtgtacggacgaccgtaaggtactttaatttaagttagttaggttacgaacggtacctagttcgtacccgtaaggcggggacctaaaccggggtaccctggtaacccgtacgtccctcacgtaccgcctaccgaacccgg

SEQ ID NO: 354998 - DNA, 593 bp, Homo sapiens
  misc_feature: GZ8MTXP02F0GN2.21.35.D02.1.454.CMB.2.raw
  modified_base (290)..(290): a, c, t, g, unknown or other
  misc_feature (290)..(290): n is a, c, g, or t
  modified_base (398)..(398): a, c, t, g, unknown or other
  misc_feature (398)..(398): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtcgggtccgcagactccgagccgaaggggctagagtggctggcagttancgcattcgatggaagcgatatgtactatgcggactccggtagaacgggctacttccacctatctaccgagacgacaaacttaccaaaagaccacgtctttagtttacngtaacaaatcggaacgacaagaccgtaggaaaaggaaggaaggaacacgggtactagtaataagtaacgtgacgcgacgtagtactttattagttagtggtacgaaggtacctagttacgtactacggtcggggaccgtacgggtaaccctcgggtaaccacccgtcttcccgacgtacgccctaccgaaaccgg

SEQ ID NO: 354999 - DNA, 643 bp, Homo sapiens
  misc_feature: GZ8MTXP02IB567.21.35.D02.1.454.CMB.2.raw
  modified_base (247)..(247): a, c, t, g, unknown or other
  misc_feature (247)..(247): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgactttgcatgcacgtggtccncagacctcgaggcaaggggctagagtggctggctagttatcgctagttcgagtggaagcgtatagtcgtactagtcggcggactccggtaggaacggccgtattccacattccacgaggacactaaacttcccgaaaataccgacgtcttagtttcagaactaaaagtcggaagcgaaacgtccgaaggaaaacgaacgggacggaaccgacgggttactaggtaaacttacgtaactaggtcggacgtacggtaacgttacctttaattacgttagtacggttacgacgggtaacctagtacggtaaccgttaacggtcggggaaccctaacggggtacccctggtaaccctaacccggttctaccctacgaccgtacccctaaccgaacccggg

SEQ ID NO: 355000 - DNA, 546 bp, Homo sapiens
  misc_feature: GZ8MTXP02GA2VD.21.35.D02.1.454.CMB.2.raw
  modified_base (247)..(247): a, c, t, g, unknown or other
  misc_feature (247)..(247): n is a, c, g, or t
  modified_base (341)..(341): a, c, t, g, unknown or other
  misc_feature (341)..(341): n is a, c, g, or t
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccncagactccaggcaaggggctagagtggctggcagttatcgcattcgatggaagcgatatgtactatgcggactccgtgaacgggcatcacatcncagancatccaaagacacgnttgttcngacaaatgagcagcctagaaagaagagacacggactagtatataacgtgtacgacgacgtacggactttagttaacttagtggttacgaacgggtacctagttacgacgtacgtcggggaccctaacggggtacccctggtaacccaccggtctcctacacgtccctaccgaacccgg

SEQ ID NO: 355001 - DNA, 550 bp, Homo sapiens
  misc_feature: GZ8MTXP02G9Y91.21.35.D02.1.454.CMB.2.raw
  modified_base (246)..(246): a, c, t, g, unknown or other
  misc_feature (246)..(246): n is a, c, g, or t
  modified_base (288)..(288): a, c, t, g, unknown or other
  misc_feature (288)..(288): n is a, c, g, or t
  modified_base (355)..(355): a, c, t, g, unknown or other
  misc_feature (355)..(355): n is a, c, g, or t
  modified_base (380)..(380): a, c, t, g, unknown or other
  misc_feature (380)..(380): n is a, c, g, or t
  modified_base (388)..(388): a, c, t, g, unknown or other
  misc_feature (388)..(388): n is a, c, g, or t
  modified_base (427)..(427): a, c, t, g, unknown or other
  misc_feature (427)..(427): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtcctgagagtctcctgtgcagcctctggattcagcttcagtgactttgccatgcacgtgggtccnccagacctccgaggcaaggggctaggagtggctggcagttancgcatttcgagtggaagcgatatgtactagcgcggactcgtagaacgggcacttcacatctacaganctaattacaagacacgtctgtttcngtacaaangagcagctagaaaagagagacaggctagtaatataacgngtacggaccgagtagtactttagttaaatttagtaggttacgacggtacctagttacgacttaggtcgggaccgaacgggtacctcggtaaccacgttctcctcgaccgtcctacccaaccgg

SEQ ID NO: 355002 - DNA, 569 bp, Homo sapiens
  misc_feature: GZ8MTXP02FG4ZL.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactccaggcaaggggctagagtggctggcagttatcgcattcgatggaagcgatatgtactatgcggtactccgtggaaacgggccgattcaccatctccagagacaattacccaaagaacacgctagtttctagacaaaatgagcagcctaggaaaagaaagagacacggctagtaatataactgtagcgcgaaggtaccttaagttatagtgttcgaagggtaccaagttcgactacgtacgggggccaaacgggggaaccccttggtaaccgtacccggttacctcccgtcgacggtccctacccgaaacccgg

SEQ ID NO: 355003 - DNA, 616 bp, Homo sapiens
  misc_feature: GZ8MTXP02F5I6A.21.35.D02.1.454.CMB.2.raw
  modified_base (250)..(250): a, c, t, g, unknown or other
  misc_feature (250)..(250): n is a, c, g, or t
  modified_base (290)..(290): a, c, t, g, unknown or other
  misc_feature (290)..(290): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtcgggtccncagactccgaggcgaaggggctagagtggctggctagtancgacattcgagtggaagcgaatatgtactagtgcggactcgagaacggccattcactactctcgaagacgactaactaccaaagaaccacgtctttagtttccagactaaaagtgaacgacaagtacctaaggaaaaagaacgggaaggaaccgaacggtactaagttaaactaactaacgttcggacggaccgtaccggtaaagttacctttaattaacgttgtagggtacgaagggtacctaagtttacgaccgttacggcggggaccgtaacggggtaacccctgggaacctaccgtcttaccacgacgtcccacgaacccgg

SEQ ID NO: 355004 - DNA, 656 bp, Homo sapiens
  misc_feature: GZ8MTXP02IEM7Y.21.35.D02.1.454.CMB.2.raw
  modified_base (363)..(363): a, c, t, g, unknown or other
  misc_feature (363)..(363): n is a, c, g, or t
  modified_base (475)..(475): a, c, t, g, unknown or other
  misc_feature (475)..(475): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgtccagcctgggactcctgagagtctcctgtgcagcctctggattcagtcttcagtgtactttgcctatgctacgtgggtcccgccagacctccgaggcgaaggggctaggagtggctggctagttactcgactagttcgagtaggaagtcgaatagtgtaactagtcgacgactccggtaggacggctactcaccntcacagaacactaaactacaaagaacctacgtcttatttcgagtaacaaagtcgacacgacgacgtaaagaaaacgaaggacgacgaacggtattaagtaaagtaattaagngtacggacgtacgtaacgttaactttaagtttagttaacggtcggtaacgaacggttaccttaagttacggaaacgttacggggaccggggtaaaccgtaaccggggtaaccgttacgggtaacccttaccggttacctcccggttaacgaccccgtaccccgttaaccggaaaccccggg

SEQ ID NO: 355005 - DNA, 674 bp, Homo sapiens
  misc_feature: GZ8MTXP02GEJNI.21.35.D02.1.454.CMB.2.raw
  modified_base (246)..(246): a, c, t, g, unknown or other
  misc_feature (246)..(246): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggactccctgagagtctcctgtgcagcctctggattcagcttcagtgactttgccatgcactgggtccncagactccaggcaaggggctagagtgctggcagttacncgntatcgagtaggaacgtcgtatagtagtaactagtcggaccggtacgtccggaggaacgggtcctaacttaccgacctactcctaccgaagaacgtacctaaacttaccgaaaagaaccgtaccgttctttagtttacctacgtaaactaaaagtacggaacgacgaacgtaccgtaaaggaaaacggtaaacggaacggaaccgtacggtacgttaagttaaacttaaacgtaacgtacgtacggtaccggtacggtaacgttaactttaaagtttaacttagtacgtacgtaacggtaactagttacgtaacgtacggacgggtacccgtaacggtacccgtacgtaaccgtaccgtcctaccacgtaccgtaccctaccgaaccg

SEQ ID NO: 355006 - DNA, 729 bp, Homo sapiens
  misc_feature: GZ8MTXP02GI1CQ.21.35.D02.1.454.CMB.2.raw
  modified_base (250)..(250): a, c, t, g, unknown or other
  misc_feature (250)..(250): n is a, c, g, or t
  modified_base (303)..(303): a, c, t, g, unknown or other
  misc_feature (303)..(303): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcatgtgcagcctctggattcagtcttcagtgtactttgccatgcacgtgggtccncagactccaggcaaggggctagagtggctggcagttatcgcattcgatggaancgaatatgtactagtggacgacgtccggtaggaacggggccccgtaattccgaaccattccctaccgaagtacgaacctaaacttacccgaaaagaacctaacgtccgtttagtttacccgtagaacctaaaagtagacgtaccgaacgacccgttaaaggaaaaaacggaagaaacgggtaaccgaaccggtacttaaggttaaattaaagttaaaccgttagggtacgaccggtacggtaaacggttaacccttttaagtttaagtttagtttacggttaacgtaaacggggtaacccttaaagtttacggaaaccggttaaccggttacgggggaacccgtaaaccgggggtaacccccgttaaggggtaccccgtaaccggttccctacccttaccgaacccggtaccccttaaacccccgg

SEQ ID NO: 355007 - DNA, 686 bp, Homo sapiens
  misc_feature: GZ8MTXP02GX2SP.21.35.D02.1.454.CMB.2.raw
  modified_base (286)..(286): a, c, t, g, unknown or other
  misc_feature (286)..(286): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtggtccgcagacctcaggcaaggggctagagtggctggcagttacncgactagtgagtaggaagcgtaatagtgtaactagtcggaccggtacgttaccggtaggaaacgggtcctaacttacccgaacctactccgtaccgaagaacgtacctaaaccgtaccgaaacgaacctaccgttcgtttacgtttacgagtaactaaagtgaacgtacgaacgtaccgtaaaggaaaacggaaacggaacggaaccgtaaccggttacgttaacgttaaactaaacgttaaacgtggtacggaccgtaacggtaacggttaacctttaagtttaagttacgttacgggtacgaacgggtacctagttacgtacggtacggtacggggaccgtaacggtacccgtaggtaacccgtaccgtcctaccgtacgaccgtccctaccgaaccg

SEQ ID NO: 355008 - DNA, 788 bp, Homo sapiens
  misc_feature: GZ8MTXP02IBW33.21.35.D02.1.454.CMB.2.raw
  modified_base (257)..(257): a, c, t, g, unknown or other
  misc_feature (257)..(257): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggaggtcggggggaggcgtgttccagccgtgggacgtcctgagagtctcctgtgcagcctctggattcagtcttcagtgtactttgcctatcgacacgtcgggtcccnccaagacctccgaggcgaaggggctaggagtggctggactagttactcgactagtttcggagtaggaaagcgtaatagtcgtaactagtcgggccggtacctccggtaaggaaacggggcccttaacttaccccaaacccgtacttacctacccgaaaggtaaccgtaacctaaacgttaaacccgaaaacgtaaacccgtaaccgttctttaccggttttcccaaagtaaccgaaaaagttcggaaacgccgtaaaccgtaccgtaaaaggaaaaacggaaacgggaaacgggaacgtaaacgggtacttaaaggttaaacttaacggttaacgtaggttacggaccgacggtaaacgttaaccttttaagtttaacgttaaggttcggggtttaaacgaacggggtttaaccctaagtttaccggaaacttaacgggtccgggggaacccgtaaccggggtaacccgttccggtaacccgtacccgtaccttcccgaccgtaaccgtaccccgtaaccgaaaccccggg

SEQ ID NO: 355009 - DNA, 648 bp, Homo sapiens
  misc_feature: GZ8MTXP02FK02I.21.35.D02.1.454.CMB.2.raw
  modified_base (250)..(250): a, c, t, g, unknown or other
  misc_feature (250)..(250): n is a, c, g, or t
  modified_base (397)..(397): a, c, t, g, unknown or other
  misc_feature (397)..(397): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcgggggaggcgtgttccagcctgggacgtccctgagagtctcctgtgcagcctctggattcagcttcagtgactttgccatgcacgtgggtccnccagactccgaggcaaggggctagagtggctggcagttactcgcatttcgatggaagcgaatatgtaactagtcggacggaccgtcggaaggacgggctacctaccactactccacaaggaactactaactaaacaaacgtaaaccncgttacgtttacgtactaagaaactaaagtagaacgtacaacgtaacgaaaggaaaacggaacggaacgtaacgacgtataagtaaataacgtagtggacggacgtacgtaacttactttaagttagttaggtcgtaacggtacgtaacttagtacgtaacggtacgggtaccggaccggtaaccgggtccgttaccgtaacccgtacccgttcccgtaccgaccgtacccgacccgtaaccgaaacccgg

SEQ ID NO: 355010 - DNA, 688 bp, Homo sapiens
  misc_feature: GZ8MTXP02JUXRQ.21.35.D02.1.454.CMB.2.raw
  modified_base (245)..(245): a, c, t, g, unknown or other
  misc_feature (245)..(245): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactggtccncagactccaggcaaggggctagagtgctggcagttacncgnagttcgagtggaagcgtatatgtaactagtcggcgactccggtaggaacgggtcctacttccacctatcctacgaagacgacctaacgttacccgaaagaaccgcgtctttagtttacctagaactaaagtgaacgacgaacgtaccgtaaggaaaaggaacggaacgggaacgtacgggtacttaggttaaactaacgttaacgtggtacggaccggtacggtaacggttaacctttaagttaacgttacggttcgggttacgaacgggtaaccttaggttacggtaacccggttacgggtaccggggtaacccgtaaccggggtaaccccgtcgggtaacccgtaacccggtttacccgtacccgtacccgtaccggtacccccgtaacccgaaacccgg

SEQ ID NO: 355011 - DNA, 627 bp, Homo sapiens
  misc_feature: GZ8MTXP02FLVI3.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagtgtactttgccatgctacgtcgggtccgccagactccgaggcgaaggggctaggaggtggcgtggctagttatcgctagttcgagtggaagcgatatgtactagtcggcggtactccggtagaacggggcctactaccacctatcctaccgaagaactaccaacttaccaaacgaaaccacgtcttgtttctacgaactaaagtgacgcacgtacgaggaaaagaacggacgacgacgacgttagtaacttaagtaacgtggtacggacgtaccggtaaggttacctttaagtttaacgttagtacggttacgaagggtacctagttgtaacgtcggacgggtaccgacggtaccgtcggtaaccgtaccgtctccctacgaccgtcccacccgtaaaccgg

SEQ ID NO: 355012 - DNA, 542 bp, Homo sapiens
  misc_feature: GZ8MTXP02HX7LO.21.35.D02.1.454.CMB.2.raw
  modified_base (247)..(247): a, c, t, g, unknown or other
  misc_feature (247)..(247): n is a, c, g, or t
  modified_base (301)..(301): a, c, t, g, unknown or other
  misc_feature (301)..(301): n is a, c, g, or t
  modified_base (348)..(348): a, c, t, g, unknown or other
  misc_feature (348)..(348): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgacttttgccatgcactgggtccnccagactccaggcaaggggctagagtggctggcagttatcgcattcgatggaancgatatgtactatgcggactccgtgaggccgatcaccatctccagancaattccaagaaccagctgtttcagacaatgagcagcctagaaagaacgaggacacggctagtaatataactgtacgcgacgaggactttagtaatttagtgtcgagggtactagttagacgtacgtcgggggacctaacggggacccttgggtaaccgtacccgtctacccgtcaccgtccctacccaacccg

SEQ ID NO: 355013 - DNA, 562 bp, Homo sapiens
  misc_feature: GZ8MTXP02HWGXT.21.35.D02.1.454.CMB.2.raw
  modified_base (249)..(249): a, c, t, g, unknown or other
  misc_feature (249)..(249): n is a, c, g, or t
  modified_base (352)..(352): a, c, t, g, unknown or other
  misc_feature (352)..(352): n is a, c, g, or t
  modified_base (403)..(403): a, c, t, g, unknown or other
  misc_feature (403)..(403): n is a, c, g, or t
  modified_base (430)..(430): a, c, t, g, unknown or other
  misc_feature (430)..(430): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcgggggagcgtgttccagcctgggacgtccctgagagtctcctgtgcagcctctggattcagcttcagtgactttgccatgcacgtgggtccnccagactccgaggcgaaggggctagagtggctggctagttatcgctattcgagtggaagcgaatatgtactagtggcggactccgtagagggccattcaactntcctcgagagactaaattaccaaagaacacgtctagtttcagacaaatgancgagtacaagaaagagaagacacggtntagtataatactgtagcgagacgtacttatagttagtgtagaacggactagttcgacgttaacggcgggaccgaacgggtacccgtcggtaacctaccgttccgtacctcgtaccgccctaacccgacccgg

SEQ ID NO: 355014 - DNA, 564 bp, Homo sapiens
  misc_feature: GZ8MTXP02GWXDD.21.35.D02.1.454.CMB.2.raw
  modified_base (249)..(249): a, c, t, g, unknown or other
  misc_feature (249)..(249): n is a, c, g, or t
  modified_base (308)..(308): a, c, t, g, unknown or other
  misc_feature (308)..(308): n is a, c, g, or t
  modified_base (440)..(440): a, c, t, g, unknown or other
  misc_feature (440)..(440): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccnccagacctccgaggcgaaggggctaggagtggctggcagttatcgcagttcgatggaancgatatgtactagtgcgactcgtagaacgggcattccacatcacagacgacaataccaaagaccacgtctgttctagacaaatgacgcagactagaaagaaggacgacacggtactagtaactaattaacgngtacgacgacgtaagtaccttagttacgttagtaggtacgaacgggtactagttagacgtacggcggggaccgtaacggtaccgtcgtaaccgacgtcctacgtacaccgtccctacgaacccg

SEQ ID NO: 355015 - DNA, 685 bp, Homo sapiens
  misc_feature: GZ8MTXP02HA52R.21.35.D02.1.454.CMB.2.raw
  modified_base (301)..(301): a, c, t, g, unknown or other
  misc_feature (301)..(301): n is a, c, g, or t
  modified_base (329)..(329): a, c, t, g, unknown or other
  misc_feature (329)..(329): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacgtggtggaggtcgggggagcgtgttccagcctgggactcctgagagtctctgtgcagcctgtggattcagcttgacgtgactttgcctatcgcacgtgggtcccnccagacctccgaggcgaaggggctaggngtggctggctagttatcgactattccgagtcggaagcgattatagtactagtgaccgggtactccggtaggaaacggggtcccaaattccaacccgtattaccgtacccaaggaacgtaaacctaaacgttaaccgaaacgtaaaaccgccgtacgtttaggttttacccaaggtaacctaaaacgtggaacgaccgtaacgacccggttaaaaggaaaaggtaaacgggaacggaaaccggaccgggtaactaaggttaaacgttaaataaaccggtggtacggaccggtacggaaacggttaacctttaagttaacgtttacgtacgggttaccgtaacggggtacctttaagg

SEQ ID NO: 355016 - DNA, 616 bp, Homo sapiens
  misc_feature: GZ8MTXP02GL5DC.21.35.D02.1.454.CMB.2.raw
  modified_base (250)..(250): a, c, t, g, unknown or other
  misc_feature (250)..(250): n is a, c, g, or t
  modified_base (276)..(276): a, c, t, g, unknown or other
  misc_feature (276)..(276): n is a, c, g, or t
  modified_base (310)..(310): a, c, t, g, unknown or other
  misc_feature (310)..(310): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcgggggagcgtgttccagcctgggacgtccctgagagtctcctgtgcagcctctggattcagcttcagttgactttgccatgcacgtggtcccncagacctcgaggcgaaggggctaggngtggctggctagttatcgatagttcgagtggaancgtaatatgtactagtcgaccggtactccggagacgggctactccaccatcctcaagagacctaactaccgaaagaaccgacgtcttgtttcagtactaaaacgtgaacgcgaagacctaaggaaaagaaggacggacgacggtactagtaaactagtacgtggtacgacgacgtaacgtactttagttacttagtcggttacgacgggtaactagttacggaacttacggacggggtaccgaacggggtaccctacggtaacctaccccgttcttacccgacgacgtccccgtacgaaaccccgg

SEQ ID NO: 355017 - DNA, 578 bp, Homo sapiens
  misc_feature: GZ8MTXP02H9X3M.21.35.D02.1.454.CMB.2.raw
  modified_base (290)..(290): a, c, t, g, unknown or other
  misc_feature (290)..(290): n is a, c, g, or t
  modified_base (305)..(305): a, c, t, g, unknown or other
  misc_feature (305)..(305): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagacctccgaggcaaggggctaggagtggctggcagttancgcattcgatggaancgatatgtactatgcgactccgtagaggccgatccaccatctcagacacaattccaaagaaccacgctgtttcagtacaaatgagcagaccgtagaaaagaagaggacacggactagtaataagttaacgtgtagcgacgagtactttattagttagtggttacgagggtacctagttacgaacgttaacggtcggggacccgtaacggggtaaaccccgtcggtaacccgtaccgtccgtaccctacgtaccggtcccttacccgaacccgg

SEQ ID NO: 355018 - DNA, 734 bp, Homo sapiens
  misc_feature: GZ8MTXP02JIHUZ.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagtgtactttgccatgcacgtgggtccgccagacctccgaggcgaagggctaggagtggctggctagttatcgactattcgagtggaaagcgtaatatagtactagcggcggtactccggaggaaacggggccctaattccgaacctactcctacgaagtaacgacctaacttaaccgaaaagaaaccacggtcttagtttaccagaacctaaaagtgaacgcaacgacctaaagaaaaacggaaagaaagggaaaccgaacgggtacttaaagtaattaaaagtaacgtagggtagaccggaacggttaacggttaacctttaaagtttaaacgttaagttacggggtttaaccgaaacgggggttaaacccttaagtttacggaaaccggtttaaacggaacgggggtaacccgtaaaaccgggggtaaaccccgttaacgggttaacccggaaacccctttccggttaccctaccggaacccgttcccctaaccccggaaaaccccgg

SEQ ID NO: 355019 - DNA, 643 bp, Homo sapiens
  misc_feature: GZ8MTXP02FHDZ2.21.35.D02.1.454.CMB.2.raw
  modified_base (292)..(292): a, c, t, g, unknown or other
  misc_feature (292)..(292): n is a, c, g, or t
  modified_base (492)..(492): a, c, t, g, unknown or other
  misc_feature (492)..(492): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatcgcacgtcgggtccgccagactccgaggcgaaggggctagagtggctggcagttancgctattcgatggaagcgatagtcgtactagtggacgggtactgggtaggaaacggggtcgaacttccaccgtatctaccgaagaacgtaccaaacttaccgaaagtaacctacgtcttacgtttacagtacaaaatgagacgtacgacctaaggaaaaaggtaacgacgggaacacggtactagtaaattacttaacgngtacgacggacgtaacgttactttatttacgtagtcggttacgaagggtactaagttcggaaccgttacggtcggggaacccgtaaccggggaacccgttcggaaccgtaccggttcctacctaccgaccgtaccctacccgaaaccccgg

SEQ ID NO: 355020 - DNA, 724 bp, Homo sapiens
  misc_feature: GZ8MTXP02GYVCZ.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagtgtactttgccatgcacgtcgggtccgccagacctcgaggacgaaggggctaggtagtgggctaggctaggttactcgctaagtcgagtacggaagtcgaagttagtacggtaactagtcggaccggtaccgtaccggtacggggaaaccgggtccgtaacctttaccgaacctacgtccctacgaaacgtaactaccttaaacttaccaaaacgtaaaccgtccgtacgtttcgtttacgagtaaccaaaagtcggaagtacaacgtaccaaaggaaacgaaacggaacggaacgaacggtcgttaagttaaacgtaagttaacgtggtacggcgtaaaccggtacggttaacctttaagttaacgttaggttacggtacgtaaacggtacttaaagtcggttaaaccgtacgggtacgggaccgtaacccgggtacccgttaggtaaccccgtaaccggttccctacccgactacccgtacccgaccgaaaccccgg

SEQ ID NO: 355021 - DNA, 676 bp, Homo sapiens
  misc_feature: GZ8MTXP02GHOUL.21.35.D02.1.454.CMB.2.raw
  modified_base (250)..(250): a, c, t, g, unknown or other
  misc_feature (250)..(250): n is a, c, g, or t
  modified_base (291)..(291): a, c, t, g, unknown or other
  misc_feature (291)..(291): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtcgggtccnccagactccgaggcaaggggctagagtggctggctagttancgctattcgatgggaagcgatatgtaacttagtcgcggacgtccggtaggaacggggcctagttccacctatccgaccagaacgactaaacttaccaaagaacctacgtcttagtttacctagacctaaaagtcgaacgacaagtacctaaagggaaaacgaagaacggaacacgggactagttaatacgtaacgtgtacggacgtacggtaagttacctttaaagttaacgtttacggttacggtttacgaaacgggttaaccctaagttccggtaaaccggttacgggtcgggggtaacccgtaaacggggtaacccccgttgggtaacccgtacccggttacgtccccgttacgaccgtcccccgttaaccggaaaccccgg

SEQ ID NO: 355022 - DNA, 592 bp, Homo sapiens
  misc_feature: GZ8MTXP02GPY4W.21.35.D02.1.454.CMB.2.raw
  modified_base (303)..(303): a, c, t, g, unknown or other
  misc_feature (303)..(303): n is a, c, g, or t
  modified_base (346)..(346): a, c, t, g, unknown or other
  misc_feature (346)..(346): n is a, c, g, or t
tcagtcgtcgctcgcacgaccggtgctcgatttagcacacgatagttgggtttggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggagcgtgttccagcctgggacgtccctgagagtctcctgtgcagcctctggattcagtcttcagtgtactttgccatcgcacgtcgggtcccnccagacctccgaggcaaggggctaggagtggctggctagttancgctagttcgatggaagcgatatgtactagtcgcggtactccggtagaaacgggccgtatccacctatcctaccaagaacgactaaacttaccaaaagaacacgtacttgtttacagtaacaaatgaagaccgaagtaccgtaaggaaaagaaggaacggacgacggtactagtaataataacgtaggtcgacgacgtaacggtaacctttaagttaacttagtcggttacgaacgggtacctaag

SEQ ID NO: 355023 - DNA, 620 bp, Homo sapiens
  misc_feature: GZ8MTXP02JU3X0.21.35.D02.1.454.CMB.2.raw
  modified_base (250)..(250): a, c, t, g, unknown or other
  misc_feature (250)..(250): n is a, c, g, or t
  modified_base (291)..(291): a, c, t, g, unknown or other
  misc_feature (291)..(291): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagtgtactttgccatgcacgtgggtccnccagacctcgaggcaaggggctagagtggctggctagttancgctagttcgatggaagcgatatgtactagtgacggtactccggtagaacgggccacttccacctatcctccaagacgactaacttaccgaaagtaaccacgtctttgtttacagtactaaaagtcgagtcaagcctaaggaaagaaggacggaccacgggtactaggttaaactagtaaacgtggtacggacgtacggtaacggtacctttaattacgttagttcggtacgaacgggtacctagttacgactacgggtacggggaccctacggggtaacccctggtaaccctaccgtcgtaccgtacgaccggtccctaccgaacccg

SEQ ID NO: 355024 - DNA, 633 bp, Homo sapiens
  misc_feature: GZ8MTXP02JFK1F.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagacctccgaggcgaaggggctagagtggctggcagttatcgctattcgagtggaagcgtaatatgtaactagtggcggtactccggtaggaaacggggtccgtaacttccgacctatcctaccgaggacgacaaacttccaaaagacacgtcttagtttctagactaaagtgacgactagacctagaaaagaacgaggacacggtactagtaatagtaaacgtggtacggacgacggtaacggtactttaagttagtttaagttggttacgaaacgggtacctagtttacgacgtaacggtcggggacccgaacggggtaaccccgtgggtaaccctacccgttccgtacccttacgacccggtaccctacccgaacccgg

SEQ ID NO: 355025 - DNA, 691 bp, Homo sapiens
  misc_feature: GZ8MTXP02HSBIH.21.35.D02.1.454.CMB.2.raw
  modified_base (249)..(249): a, c, t, g, unknown or other
  misc_feature (249)..(249): n is a, c, g, or t
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtgggtcccnccagacctccgaggcgaaggggctaaggngtggctggctagttancgctagttcgatgggaaagcgaattagtgtaactagtcggcggtactccggtaggaacggggcctacttccaacctatcctaccgaagaagtacctaaattacccaaaagaacctacgtctttgtttcctagaactaaaagtgaacgcaacgtacctaaaggaaaagaaggaacggaccgtaacggacttaaggttaaattaacttaaacgtggtacggaccgtaacggtaaacgttaaccgtttaatttaacgtttaaggttacgggttaaccgaaacgggtaaccttaagtttaccgggaaacttacgggttacgggggacccgtaaccggggtaacccgttacggtaaccctacccggttcctaccctacgaccgtaccctaacccgaacccgg

SEQ ID NO: 355026 - DNA, 648 bp, Homo sapiens
  misc_feature: GZ8MTXP02IHTYJ.21.35.D02.1.454.CMB.2.raw
  modified_base (242)..(242): a, c, t, g, unknown or other
  misc_feature (242)..(242): n is a, c, g, or t
  modified_base (281)..(281): a, c, t, g, unknown or other
  misc_feature (281)..(281): n is a, c, g, or t
  modified_base (296)..(296): a, c, t, g, unknown or other
  misc_feature (296)..(296): n is a, c, g, or t
  modified_base (322)..(322): a, c, t, g, unknown or other
  misc_feature (322)..(322): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtgagtcggggagcgtgttccagcctgggactcctgagagtctcctgtgcagcctctggattcagcttcagtgactttgccatgctactggtccncagactcgaggcaaggggcagagtggactggacagttancgcattcgagtggancgatatgtactagtcgacgactccgngaaacgggtcctagttaccgaacctatacctccgaagacgactaacttaccgaaacgaaacctacgtctttagtttacctaggaactaaaacgtgaacgacgaagtacccgttaaggaaaaaggaaacggaaacgggaacgaacgggtacgttaaggttaaataaacgttaaacgtggtaggaccgacggtaaggtaacctttagttaaacgtagttacgttacgaacgggtaacctagtttacggaaacttacggacgggtaccgtaaacgggtaccctacggtaaccgtaccggtctacctacgaccgtccctaccgaacccgg

SEQ ID NO: 355027 - DNA, 730 bp, Homo sapiens
  misc_feature: GZ8MTXP02GI3LT.21.35.D02.1.454.CMB.2.raw
  modified_base (251)..(251): a, c, t, g, unknown or other
  misc_feature (251)..(251): n is a, c, g, or t
  modified_base (293)..(293): a, c, t, g, unknown or other
  misc_feature (293)..(293): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgcctatgcacgtgggtccnccagacctccgaggcaaggggctaggagtggctggctagtancgctattcgatggaagcgtaatatcgtaactagtcggcggtactccggtaggaaacggggcctaagttccaacccctagttaccctaccgaaggaacgtacctaaaacttacccgaaaagaacccgtaccggtctttacgggtttaccctaggaaacctaaaagtcggaacgtaccgaacgtacccgtaaaggaaaacggaaagggaacggttaaaccgaacggggtaccttaaagggttaaattaaacttacccgttaggttaccggaccggtaaccgtaacgggtttaacctttaaagtttaacgttaagttcggtaacgtaacggggtaacctaaggttacgaaaccgttacgggtcgggggtaaccaaccggggtaacccgttcggtaacctaccggtactcccgtacgacccgaccctaacccgaacccggg

SEQ ID NO: 355028 - DNA, 721 bp, Homo sapiens
  misc_feature: GZ8MTXP02HBOBT.21.35.D02.1.454.CMB.2.raw
  modified_base (248)..(248): a, c, t, g, unknown or other
  misc_feature (248)..(248): n is a, c, g, or t
  modified_base (290)..(290): a, c, t, g, unknown or other
  misc_feature (290)..(290): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccactggtggagtcgggggagcgtgttccagcctgggacgtccctgagagtctcctgtgcagcctcgtggattcagcttcagtgactttgccatgcacgtcgggtccnccagacctcgaggcgaagggctaggagtggctggctagttancgactagtcgagtaggaaggcgaatagtagttaactagtcggtacggtacgtccgggtacggtaaacggggcctaacgttacccaaccgtactacctacccgaaggtaacgtaaccgtaaacgttaacccgaaaacggtaaacccgtaaccggtctttacggtttttacacgtaacctaaaagtacggaacggtaccaaacggtaccctaaagggaaaaggaaacggaaacgggaaccgaacggtaaccgttagttaaacgttaaacttaacgaggttcgggaacgaaccggtaaaggttaaccctttaagttaagttacggttacggtacgaacgggtaactacgtttacggacttacggggtaccgggacgtaaccgggtaacctggtaaccctacggtactaccgtcaccgtcccctacgaaacccgg

SEQ ID NO: 355029 - DNA, 588 bp, Homo sapiens
  misc_feature: GZ8MTXP02G8W5W.21.35.D02.1.454.CMB.2.raw
  modified_base (288)..(288): a, c, t, g, unknown or other
  misc_feature (288)..(288): n is a, c, g, or t
  modified_base (344)..(344): a, c, t, g, unknown or other
  misc_feature (344)..(344): n is a, c, g, or t
  modified_base (349)..(349): a, c, t, g, unknown or other
  misc_feature (349)..(349): n is a, c, g, or t
  modified_base (363)..(363): a, c, t, g, unknown or other
  misc_feature (363)..(363): n is a, c, g, or t
  modified_base (374)..(374): a, c, t, g, unknown or other
  misc_feature (374)..(374): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtgggtccgccagactccaggcgaaggggctagagtggctggcagttancgcattcgatggaagcgatatgtactatgcggactcgtagaacggcatcaccatcncaganacaattcaagaacncgtctgtttcngacaaagtgagcagacctaggaaagaagacggacacggactagtaatagtaacgtgtagacgacgaacggtacctttaattaacttagtaggttacgaagggtaacctagtttacggaacttaacggtcgggggacccgtaacggggtaaccccgttaggtaacccgtaacccggtcctacccgtaccgaaccgtcccctacccgaaaccccgg

SEQ ID NO: 355030 - DNA, 612 bp, Homo sapiens
  misc_feature: GZ8MTXP02I4HF4.21.35.D02.1.454.CMB.2.raw
  modified_base (299)..(299): a, c, t, g, unknown or other
  misc_feature (299)..(299): n is a, c, g, or t
  modified_base (486)..(486): a, c, t, g, unknown or other
  misc_feature (486)..(486): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtcggtccgccacgacctccgaggcgaaggggctaggagtggctggactagttatccgntagttcgagtaggaacgtcgaattacgtgtaacttagtcgcggtacgtccggtaggaaacggggcctagtaccacctatcctacaagacgactaacgttaccaaaagaccacgtcttagttctagactaaatgacgcagacctaaggaaaagaagaacggacgacgtacttagtaactaagtaacgnggtcgacgtacggacgttaacttagttacgttagttacggtacgaacgggtactagttacgacgttacggtccgggacgaacggtaccgtggaacctacgtcctacgtcacgtccctacgaaccgg

SEQ ID NO: 355031 - DNA, 745 bp, Homo sapiens
  misc_feature: GZ8MTXP02JYT2Y.21.35.D02.1.454.CMB.2.raw
  modified_base (254)..(254): a, c, t, g, unknown or other
  misc_feature (254)..(254): n is a, c, g, or t
  modified_base (300)..(300): a, c, t, g, unknown or other
  misc_feature (300)..(300): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctcgtggattcagtcttcgagtcgtactttgccatgcacgttgggtcccnccagacctccgaggcgaaggggctaggagtggctggactagttacncgactagttcgagtggaaagcgatatgtactagtcgcggtacgtccgtaggaacgggcctattaccacctatccctacagtacgaccaaacttaccaaagaacctccgtctttagtttaccagaaactaaagtcgaacgtaccaacggtaacccgtaaaggaaaacggaaacggacgggaaccgtaaccggtacgttaaggttaaattaaacggttaaccgtggtaccgggaccgtaaaccgggtaacggttaaaccttttaaagtttaagtttacggttacggggtttaacggaaacggggttaaccctttaaaggttacggtaaacccggtttaacgggacccgggggttaacccgtaaaacccgggggtaacccgttacggtaaccccgtaacccgttccgttaccccgtacgaaccgtacccccgtaccgtaaacccccgg

SEQ ID NO: 355032 - DNA, 829 bp, Homo sapiens
  misc_feature: GZ8MTXP02H6ZIR.21.35.D02.1.454.CMB.2.raw
  modified_base (250)..(250): a, c, t, g, unknown or other
  misc_feature (250)..(250): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggactcctgagagtctcatgtgcagcctctggattcagcttcagttgtactttgcctatcgcacgtcgggtccnccagactccgaggcaaggggctaggagtggctggactagttacncggctacgttcgagtacggaagcgtaattattacgtaacttagtcggaccggtaaccttccggtaagggaaacggggtcccccctaagtttcccaaacctacgttacctacccaaggtaccgaaaccttaaaacgtttacccccgaaaaagtaacccgtacggtacctttacggttttaccgtagaaccgtaaaagttacggaacgaaccgtaacggtacccgttaaaggggaaaaaacggaaaacgggaaacgggaaacccgtaaacggggtaccgttaaagtttaaaacgttaaacgttaaaaccggttggtaaccgggtaccggtaaccgggttaaaccgggtttaaaccctttttaaaagttttaagttttaacgggttacgggttttaaacccggaacggggttaacccttaaaggtttacgtaaaccggttaacggttcgggggaaaccccgaaacggggttaaaccccgtcggttaaccccgtacccggtttaccctaccgtacccgtaccgtaccccgtaaccccgg

SEQ ID NO: 355033 - DNA, 710 bp, Homo sapiens
  misc_feature: GZ8MTXP02HETDW.21.35.D02.1.454.CMB.2.raw
  modified_base (247)..(247): a, c, t, g, unknown or other
  misc_feature (247)..(247): n is a, c, g, or t
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagactccaggcaaaggggctagagtggctggcagttacncgntagtcgagtaggaagcgtaatagtagtaactagtcggacggtacgtccggtaaggaaacggtaccgtacttaccaacctatacctacgaagaacgtaactaaacttaaccgaaaagaaaccacgtctttacgtttacagtaaactaaaagtgaacgacgaacgacgtaaaggaaaaagaaacggaacgggtaaccgaacggtacttaagtaaacttaaacgttaacgtaggtacgggacggaacggtaaacggttaacctttaaagtttaagttaaggttacgggttaacgaaacggtaccttaagtttacggaaaccgttaacgggtacgggggaacccgtaacggggtaaccccgttcggtaacccgtacccgttaccctacccgtaaccgaccgtaccccctaacccgaaacccgg

SEQ ID NO: 355034 - DNA, 570 bp, Homo sapiens
  misc_feature: GZ8MTXP02HBYUY.21.35.D02.1.454.CMB.2.raw
  modified_base (247)..(247): a, c, t, g, unknown or other
  misc_feature (247)..(247): n is a, c, g, or t
  modified_base (284)..(284): a, c, t, g, unknown or other
  misc_feature (284)..(284): n is a, c, g, or t
  modified_base (353)..(353): a, c, t, g, unknown or other
  misc_feature (353)..(353): n is a, c, g, or t
  modified_base (381)..(381): a, c, t, g, unknown or other
  misc_feature (381)..(381): n is a, c, g, or t
  modified_base (392)..(392): a, c, t, g, unknown or other
  misc_feature (392)..(392): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccnccagactcaggcaagggctagagtggctggcagttancgcatttcgatggaagcgatatgtactatgcggactccgtagaacggggccattccaccatctccaganacaattaccaaagacacgtcttgtttcngacaaatcgancagctagaaagaagagacgacgctagtatatagtagtcgcgacgaggtaccttaattattagtggtacacgggtactagttaggacgtaacgtcggggaccgtacggggtaacccgttcggtaacccgtacccggttcctacccgtaccgaccgttaccccgtaccgtaaacccccgg

SEQ ID NO: 355035 - DNA, 661 bp, Homo sapiens
  misc_feature: GZ8MTXP02HYV39.21.35.D02.1.454.CMB.2.raw
  modified_base (252)..(252): a, c, t, g, unknown or other
  misc_feature (252)..(252): n is a, c, g, or t
  modified_base (292)..(292): a, c, t, g, unknown or other
  misc_feature (292)..(292): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggaccgtccctgagagtctcctgtgcagcctctggattcagctttcagtgactttgccatgcacgtgggtcccncagactcgaggcaaggggctaggagtggctggctagttancgctagttcgagtggaagcgtatatggtaactagtcggcggtactccggtaggaaacggggtcctacttcaccctagtcctaccgagaacgtactaacttaccgaaagtaacctacgtctttgtttactagaactaaagtgagacgacgtaccgtaaggaaaacgaaggaacggacgacggtacttaggttaaacttaagttaacgtggtacgaccgtacgtaacggttaaacttttaagttaacgtttacgtacggttaacgaacgggtacctagttaacgacgttacgggtacgggacccgtaacgggtacccgtaggtcccgtacccgttcctaccgttaccgaccgtccctaacccgtaacccgg

SEQ ID NO: 355036 - DNA, 549 bp, Homo sapiens
  misc_feature: GZ8MTXP02G0XGN.21.35.D02.1.454.CMB.2.raw
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccncagctccgaggcaaggggctagagtggctggcagttancgcattcgatggaagcgatatgtactagtgcggtactccgtggaacgggtccattcacctatcctaccagacgacaattccaaagaacacgctgtttcagacaaatgagcagctagaaagaagagacacggactagtatataacgtgtgacgcgaagtacgtttattattagtaggttacaggtactagttgacgtacggtcgggaccgtacgggaacccttgggaactacccgtacgtacctacgcgtaccctaccgaacccg

SEQ ID NO: 355037 - DNA, 731 bp, Homo sapiens
  misc_feature: GZ8MTXP02J0Y3W.21.35.D02.1.454.CMB.2.raw
  modified_base (251)..(251): a, c, t, g, unknown or other
  misc_feature (251)..(251): n is a, c, g, or t
  modified_base (289)..(289): a, c, t, g, unknown or other
  misc_feature (289)..(289): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagtgtactttgccatgcacgtgggtcccncagactccaggcaaggggctagagtggctggcagttancgctattcgagtggaagcgaatacgtgtactagtcggacggtaccttccggtagggaaacgggtcccgtaattcccgaacctagtccctacgaagaacgactaaacttacccgaaaacggtaacacccgtgtttacgtttacgtacgaaactaaaagtcggaagacccaacggtacgtaaagggaaaaagaacgggaacggaacccgtaacgggtaccttaaggttaaattaaacgttaaaccgttgggtacgggaccgtaccggttaacggttaaaccttttaagtttaacttaggttacggttaacggaaggtacccgttagtttacggaaccgtttacggaccggggtaacccggtaccgggtaaccccgtttacggtaacccgtaacccggttccgttacccgtacccgtaccggtacccctacccggtaaacccggg

SEQ ID NO: 355038 - DNA, 623 bp, Homo sapiens
  misc_feature: GZ8MTXP02J1KLM.21.35.D02.1.454.CMB.2.raw
  modified_base (252)..(252): a, c, t, g, unknown or other
  misc_feature (252)..(252): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (314)..(314): a, c, t, g, unknown or other
  misc_feature (314)..(314): n is a, c, g, or t
  modified_base (469)..(469): a, c, t, g, unknown or other
  misc_feature (469)..(469): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggaggtcgggggaggcgtgttccagcctgggacgtccctgagagtctcctgtgcagcctctggattcagtcttcagtgtactttgccatgctacgtgggtccnccagacctccgaggcgaaggggctagaggtggctaggcagttancgntatttcgagtaggancgtatatgtactagtcggcggactccggtagaacggggtcctactaccactactcctacaagaacgactaacttaacccgaaagacctacgtctttagtttcacgaacaaagtcgaacgactagacgaaaggaaagaaaggacggaacgacggtnttaagtataaagtacgtgacgacgacgaacgttacttagttatagttagtacgtacggtactagtacgaccgttacgggacgggtacccgaaccgggtaccctaggtaaccctaccggtacctccgtaccgacccgttcccacccgaaacccgg

SEQ ID NO: 355039 - DNA, 730 bp, Homo sapiens
  misc_feature: GZ8MTXP02H34ET.21.35.D02.1.454.CMB.2.raw
  modified_base (200)..(200): a, c, t, g, unknown or other
  misc_feature (200)..(200): n is a, c, g, or t
  modified_base (248)..(248): a, c, t, g, unknown or other
  misc_feature (248)..(248): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacattttgcgctccactgtcaggtccacctggtgagtcgggggagcgtgttccagcctgggacgtccctgagagtctcctgtncagcctctggattcagcttcagtgactttgcctatgcacgtgggtccncagactccaggcagggctagagtgctggcagttatcgcattcgatggaagcgaatatgtactatgcggtactccgtagaaacgggccgtaattccacctatcctaccgaagacgacctaaacgtttccgaaaacgtaaaacctaccgtacgttacgttttaccgtacggtaaccaaaaagttggaaacggccgtaaagggaccccttaaaggggaaaaacggtaaagggaaacggggtaaccgtaaaccgggggccttaagggttaaacctaaaggttaaaaccgtgggttacggaccgggacgtaaacgggtacccttttaagtttaagtttaacgttagggtttaccgaaacggggtacctaaaagttttcggaaacctttaaaccggcgggggtacccgaacgggggtaaccccttacggggttaacccaacccggttcctacccgttccgaaaccggtccccttaaccgaaaccccgg

SEQ ID NO: 355040 - DNA, 550 bp, Homo sapiens
  misc_feature: GZ8MTXP02F1E3W.21.35.D02.1.454.CMB.2.raw
  modified_base (257)..(257): a, c, t, g, unknown or other
  misc_feature (257)..(257): n is a, c, g, or t
  modified_base (275)..(275): a, c, t, g, unknown or other
  misc_feature (275)..(275): n is a, c, g, or t
  modified_base (302)..(302): a, c, t, g, unknown or other
  misc_feature (302)..(302): n is a, c, g, or t
  modified_base (345)..(345): a, c, t, g, unknown or other
  misc_feature (345)..(345): n is a, c, g, or t
  modified_base (361)..(361): a, c, t, g, unknown or other
  misc_feature (361)..(361): n is a, c, g, or t
  modified_base (373)..(373): a, c, t, g, unknown or other
  misc_feature (373)..(373): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (428)..(428): a, c, t, g, unknown or other
  misc_feature (428)..(428): n is a, c, g, or t
tcagtcgtcgctcgcacgaccggtgctcgatttagcacacgatagttgggtttgggagaggagcccagcactggaagtcgccggtgtttccattcggtgatcagcactgaacacagaggactcaccatggagtttgggctgacctgggttttcctcgttgcttcttttaagaggtgtccactgtcaggtccacctggtggaggtcggggggagcgtgttccagcctgggacgtcctgagagtctcctgtgcagcctntggattcagtcttcagtntactttgccatcgcacgtcgggtcccnccagacctccgaggcgaaggggctaggagtggctggctagttncgctattcgatggaancgatatgtactngacggtactcgtaggaacggctatcacatcacagacactaatacaanaacncgtnttagttcagactaaagtgacgacgacgactaaggaaaagagaagacacggtctagtaaatacgtaaactggtacgacgacgtaacgtaactttaattaagttacgtggtacgacggtactag

SEQ ID NO: 355041 - DNA, 669 bp, Homo sapiens
  misc_feature: GZ8MTXP02FMFX8.21.35.D02.1.454.CMB.2.raw
  modified_base (250)..(250): a, c, t, g, unknown or other
  misc_feature (250)..(250): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtccncagactccgaggacgaaggggctaggagtggactgggactaggttactccgatacgtttacggagttagggaaacgtcggtaatagttacggtaactagtcggacggtaccgtccggtaggaaacgggtccgtaacctttccgaacctacgttactaccgaagacgtaactaaaccttaccgaaagtaccacgttcttggtttacagactaaagtcgaactcaacgacgtaaaggaaacgaaacgggacgaactacgggtacttaaggtactaagtacgtggacgtcgacgtagttactttaattatacgtacgggtcaacggtacctaagtttccgaaacgtacgggtaccgggaccgtaacggacccttggaacccgtaccgtacccttcgacctaccgacccttaacccgaaccgg

SEQ ID NO: 355042 - DNA, 663 bp, Homo sapiens
  misc_feature: GZ8MTXP02JHJQN.21.35.D02.1.454.CMB.2.raw
  modified_base (251)..(251): a, c, t, g, unknown or other
  misc_feature (251)..(251): n is a, c, g, or t
tcagtcgtcgctcgcacgaccggtgctcgatttagcacacgataggttgggtttgggggaagaggaagactgacggtcctgccacaggtggtgctgggcacggtgggcactcgacacaacatttgcgctccactgtcaggtccacctggtggagtcggggggagcgtgttccagcctgggactcctgagagtctcctgtgcaggcctctggattcagtcttcagtgtactttgccatgctacgtgggtccncagcctccagcgaggctagagtgctggcagtatcgcaattcgagtcggaagcgatatcggtactagtcgcgtactcggtaggaaaggtccattccaccgtactcctaccgaagacgactaaacgtttacccaaaaggtaaaccctacggacctttacggtttactacggtaactaaaacgttgaacgaacgaacgtaaccgtaaggaaaacggaaggaaacggacgtaccgggtaacgttagttaacttaaaagtacgtaggtacgggaccgtaccggtaggtaacctttaagttacgttagtacgggtacaaccgggtactacgttcgaaccgtacggtacggggacccgaacggtacccgtggaacccgtacctaccgtaccgtacgtaccgtacccgacccgaaacccg

SEQ ID NO: 355043 - DNA, 666 bp, Homo sapiens
  misc_feature: GZ8MTXP02IDCKH.21.35.D02.1.454.CMB.2.raw
  modified_base (254)..(254): a, c, t, g, unknown or other
  misc_feature (254)..(254): n is a, c, g, or t
  modified_base (301)..(301): a, c, t, g, unknown or other
  misc_feature (301)..(301): n is a, c, g, or t
  modified_base (559)..(559): a, c, t, g, unknown or other
  misc_feature (559)..(559): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagtgtactttgcctatgctacgtcgggtccnccagacctccgaggacgaaggggctaggagtggcgtggctagttacncgtacattcgagtggaagcgatagtgttactagtaggccggacgtccggtaggaacggggtcacttaccacctatccaccgaagaacacctaaattaccgaaaacgaaaccgtccgtcgtttagtttccctaggaactaaagtacgacgtaccgaagtactaaaggaaaaggaacgaaacgggactaccgggtataggtaaataacgttaagtcggtagacggacgtagttaactttattaacgtttgtacgggttanaacgggtacctaagtttcggaacttacgggcggacccgtaacgggtaccccgtaggtaaccctacccggtactttcccgtacgacccgaccgttacccaacccgggg

SEQ ID NO: 355044 - DNA, 603 bp, Homo sapiens
  misc_feature: GZ8MTXP02HO8KS.21.35.D02.1.454.CMB.2.raw
  modified_base (474)..(474): a, c, t, g, unknown or other
  misc_feature (474)..(474): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgcctatcgcacgtgggtcccgccagacctccgaggcgaaggggctaggagtggcgtggactagttatcgctattcgagtggaagcgatagtgtactagtgcggtactccgtaggaacgggccacgttccactatctacagagactaacttaccgaaagaaccgacgtcttacgtttacagtacaaaagtgacgtacgaacgtaccgtaagaaaacggagaacgacgacgctagtatatacgngtacgcgacgtagtacttagttacgttagtaggttacgaggtacctagttagtaaccgtacggttacgggaccgtacgggtaccctcggtccgtaaccgtcgtcccacgaccgtccctacccgaaccgg

SEQ ID NO: 355045 - DNA, 633 bp, Homo sapiens
  misc_feature: GZ8MTXP02FM9SY.21.35.D02.1.454.CMB.2.raw
  modified_base (248)..(248): a, c, t, g, unknown or other
  misc_feature (248)..(248): n is a, c, g, or t
  modified_base (286)..(286): a, c, t, g, unknown or other
  misc_feature (286)..(286): n is a, c, g, or t
  modified_base (302)..(302): a, c, t, g, unknown or other
  misc_feature (302)..(302): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccncagactccaggcaaggggctagagtggctggcagttancgctattcgatggaancgatagtgtactagtggcggtactccgtaggaacggtccattccaccatcctaccgaagaacgactaaacttacccaaaagtaaccacgtctttaggttttcctagaactaaaagtgaaacgtcaagtaccgaaggaaaacgaagaaggaccacggacttagtaataagtaacgtggtacgacgacgtaacgttactttagttaagttacgtaggttacgaacgggtacctagttacgtaaaccttacgggtacgggggtaccctaacggggtacccttgggtaaccctacccggttctcccgtaacaccggtacccctaccgaaacccgg

SEQ ID NO: 355046 - DNA, 785 bp, Homo sapiens
  misc_feature: GZ8MTXP02HYM6E.21.35.D02.1.454.CMB.2.raw
  modified_base (253)..(253): a, c, t, g, unknown or other
  misc_feature (253)..(253): n is a, c, g, or t
  modified_base (280)..(280): a, c, t, g, unknown or other
  misc_feature (280)..(280): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcgagtgtactttgccatcgctacgtgggtcccnccagacctcgaggcgaaggggctaggngtggcgtggctagttagcgctagttacggagtggaagcgtaatagtagtactagtggaccgggacgtgggacggaaacggggtacctacgtttaccgaccctacgtccgttacgaaggaacgtacctaaacttaacccgaaaacgtaaccgtacgttcgtttacggttttaccagtaaactaaaagtcggaacgaccgtaacggtaacccgtaaaggaaaaacggtaacggaacgggaaccgtaacggttacttaaggttaaaattaaggttaaaccgtgggttacggaccgggtaacggtaaccggtttaaccttttaagtttaaagtttaacggttacgggttaccgggtaaaacggtaccgttaggtttaaccggtaaacccggtttacgggggtaccgggggtaacccggtaaaaccggggttaaccccgtcgggttaacccgtaacccgggttcctaccccgtacgtaccccggtaccccgttaaccccgaaaccccggg

SEQ ID NO: 355047 - DNA, 608 bp, Homo sapiens
  misc_feature: GZ8MTXP02JO7UP.21.35.D02.1.454.CMB.2.raw
  modified_base (248)..(248): a, c, t, g, unknown or other
  misc_feature (248)..(248): n is a, c, g, or t
  modified_base (285)..(285): a, c, t, g, unknown or other
  misc_feature (285)..(285): n is a, c, g, or t
  modified_base (587)..(587): a, c, t, g, unknown or other
  misc_feature (587)..(587): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccncagactcgaggcaaggggctagagtgctggcagttancgctattcgagtggaaagcgtaatagtagtaactagtcggcgtacctcggtaggaagggtcctacgttccacctactccgacgaagacgactaaacttaccgaaagaacctagtctttcgtttcagactaaatgaacgcaacgctaaggaaagaaggacgacgacggtactagtaaatactacgtagtacgacggtacgtaacggttacctttaagttagttaacggtcgttaacgacggtacctagtacgacgtacgggtcggacgtaaccggacctcggtaaccgtaccgtcttaccganacccgtacccgaccgaaccgg

SEQ ID NO: 355048 - DNA, 683 bp, Homo sapiens
  misc_feature: GZ8MTXP02F03H1.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcgggggaggcgtgttccagcctgggacgtccctgagagtctcctgtgcagcctctggattcagcttcagtgtactttgccatgcacgtcggtccacgacgactcgaggacggaagggtctaggaggtggcgtggactagttacgtcgctagttcgagtaggaagacgtatagtacgtactagcggtaccggtacgtaccggaggtaacggtcctacgttaccacctactcctacgaagaacgtactaactaaccgaaacgtaacctcgttcttacgttcaaagaactaaaggcgaacgacgtacgtaaccgaaagggaaaacgaacgggtaacgaaaccgtacgggtatttaaaggtaactaaacggtacgtacggtacggaccggacgttaacgttaactttagtttaacgtcgtacggtacgacgacttaggtactacggttacgggacgggtaccgaaacggttccgtacgtaacccgtaccgtccgtaccgtaccgaccgtaccccgtaaaccgaacccgggg

SEQ ID NO: 355049 - DNA, 746 bp, Homo sapiens
  misc_feature: GZ8MTXP02FUK2L.21.35.D02.1.454.CMB.2.raw
  modified_base (250)..(250): a, c, t, g, unknown or other
  misc_feature (250)..(250): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgactttgccatgcacgtgggtcccncagcctccgaggcgaaggggctaggagtggctggctagttatcgctattcgagtggaagcgtatagtgtactagtcggacggtactccggtagaaacggtaccgtatttacccgacctaattccgtacccgaaagaacgtaacctaaaacgttacccaaaacggaaaccctacgggtactttacggttttactacggaacctaaaagtggaacgtacaacggtaccgtaagggaaaaaggaaacggaacgggaaaccgacgggtaccgttaagttaaacgttaaacgttaaccgttaggttagggacccggtaaacggtaacggtttaaacccttttaaagtttaaagtttacgttacgggttacgaacggggtaaccttagttaacggtaaccgttaccgggtacggggacccgtaaacggggtaaccccgttaggggtaaccctaccccggttcctacccgtaccgaccggtacccctacccggtaaaccccgg

SEQ ID NO: 355050 - DNA, 715 bp, Homo sapiens
  misc_feature: GZ8MTXP02JHTGC.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggtattcagtcttcagttgtactttgcctatcgctaccgtcgggtcccgccgaagacctcccgaggccgaaggggctaggaggtggctggctagttactcgctagttcgagtggaagtcgatagtgtaactagtcggcggacctccggtaggaacgggcctacttccacctatccacaagacactattacccgaaagaccagtctttacgtttctacgaactaaatacggacgacgaacgtaccgtaaagggaaaacggaaagggacgggaaccgaacgggttactaaaggtttaataaacgttaacgtagggttaccgggacccggtaaggtaaaccgggtttaacctttagtttaaacgtttacgggttaacggttacggtaacggtaacccgttaagttaccgtaaccggttacggtaccgggggtacccgaaccgggttacccgttgggtaacccgtaaccgtccgtaccgttacgacccgtaccgtaccccgaaacccggg

SEQ ID NO: 355051 - DNA, 677 bp, Homo sapiens
  misc_feature: GZ8MTXP02GY6CC.21.35.D02.1.454.CMB.2.raw
  modified_base (256)..(256): a, c, t, g, unknown or other
  misc_feature (256)..(256): n is a, c, g, or t
  modified_base (283)..(283): a, c, t, g, unknown or other
  misc_feature (283)..(283): n is a, c, g, or t
  modified_base (300)..(300): a, c, t, g, unknown or other
  misc_feature (300)..(300): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcgggggaggcgtgttccagcctgggacgtcctgagagtctcctgtgcagcctctggattcagtcttcagttgtactttgcctatgcctacgtcgggtccnccagactccgaggcgaaggggctaggngtggcgtggctagttancgatattacggagtggaagcgtaatagttagtactagtcggaccggtaccgttccggtaggaaacggggcctattaccgacctacgtcctaccgaagaacgtaacctaacgttaccaaaacgtaaccacgttctttacgttacgtagtaactaaagtgaacgccaagtaccgtaaggaaaacgaacggacggtaaccgacggtacgttacgtaaagtacgttaacgtggacgggtaccgtacggtaacgttactttaagttaagttacgttcggtacgaacggtactagttacgacgtacgggacggacccgtaaccggtaccgttcggtaaccctaccgtccgttaccgacgaccgtacccctaccgtaaacccgg

SEQ ID NO: 355052 - DNA, 650 bp, Homo sapiens
  misc_feature: GZ8MTXP02JIOYR.21.35.D02.1.454.CMB.2.raw
  modified_base (249)..(249): a, c, t, g, unknown or other
  misc_feature (249)..(249): n is a, c, g, or t
  modified_base (293)..(293): a, c, t, g, unknown or other
  misc_feature (293)..(293): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgtccagcctgggacgtccctgagagtctcctgtgcagcctctggattcagcttcagtgtactttgccatgcacgtgggtcccnccagacctccgaggcgaaggggctagagtggcgtggctagttancgctattcgatggaagcgaatagtgtaactatcggacggtactccggtaggaacgggccacttccacctactcctaccaagacgacctaacttaccgaaagtaaccacgtcttagtttcagtactaaagtcgaacgtccaacgtaccgtaaggaaaacggaacgaagggaccgaaccggtacttaagtaaactaacttaaacgtggtacgacggacgtaacggtacctttaatttacgttagttacggtacgacggtacctagttacgtacggttacggacgggggtaccgtacggggtaacccgttcggtaaccgtaccgttaccgtaccctacgacccgtccctaccgaacccgg

SEQ ID NO: 355053 - DNA, 787 bp, Homo sapiens
  misc_feature: GZ8MTXP02FFI7G.21.35.D02.1.454.CMB.2.raw
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacataacatttgcgctccactgtcaggtccacctggtggagtcgggggagcgtgttccagcctgggacgtccctgagagtctcctgtgcagcctctggattcagtcttcagtgtactttgccatgcacgtgggtcccgccagactcccgaggcgaaggggctagagtggctggcagttacncgctagttcgagtggaagcgtatatggtaactagcgacggtaccttccggaggaaacggggtcctaacgtttcccaaaccccgtattcccgtaccgaaggtaacgtacctaaaacttacccgaaaaaggaacccgtaaccggttctttacggtttttacccgtacggtaaccctaaaaagttcgggaaacggccgtaaaccggtaccccgtaaaagggaaaaaggggtaaaccgggtaacggggaaaacccgtaacgggggtacccgtttaagggttaaaaccttaaacgtttaaaacccgttggggttaaccgggtaccggtaacccggtaaacgggtttaaacccttttaagtttaacgtttaggtacggtttacgaacgggtaaccgttagttacgtacgtaccggtcgggggaccgtaaccggggtaaccgttacggtaacccgtaacccgttcctacccgttcgacccggtccctacccgaaacccgg

SEQ ID NO: 355054 - DNA, 607 bp, Homo sapiens
  misc_feature: GZ8MTXP02H7F2J.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagtgtactttgcctatgctacgtgggtcccgccagacctccgaggcgaagggctaggagtggcgtgctagttatcgctagtcgagtggaagcgaatgtagtactagtcggacggtacgtcggtaggaacggtcctaaccgtaccgaacctctccgacgagaacgactaaacgtaacgaaacgacacgtcttattcagtacaaatgagacagacgaaggaaacgaagacgacgacgatagtaactaagtactagcggacgtagaacgtacttaagttattagtcggtacgaacggtactagtttcgaacttacgggacgggaccgtacgggtaacccgttcgaaccgtccctacgttccaccgaccgtaccccgtaccaacccggg

SEQ ID NO: 355055 - DNA, 607 bp, Homo sapiens
  misc_feature: GZ8MTXP02HISPV.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcactgggtccnccagactcaggcaaggggctagagtggctggcagttatcgcattcgatggaagcgatatgtactagtgcgactcgtgaaggcatcacatctcagagacaatcaaagacacgtcttgtttacctgacaaagtgagcagacctagaaacgaagaggacacggactagttaatataacgtggtacgacgacgaacggtactttagttaagtttagttagggttacgaacggggtaacctagtttacggtaaccgttaacgggtaccgggggtacccgtaacgggggtaaacccccgttggtaacccgtaaccccggttcctacccccgtacgacccgtacccccgttaccgaaacccccggg

SEQ ID NO: 355056 - DNA, 649 bp, Homo sapiens
  misc_feature: GZ8MTXP02HJ38F.21.35.D02.1.454.CMB.2.raw
  modified_base (249)..(249): a, c, t, g, unknown or other
  misc_feature (249)..(249): n is a, c, g, or t
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
  modified_base (332)..(332): a, c, t, g, unknown or other
  misc_feature (332)..(332): n is a, c, g, or t
  modified_base (389)..(389): a, c, t, g, unknown or other
  misc_feature (389)..(389): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgcatgcacgtcgggtccnccaggtacctcgaggcgaaggggtctaggaggtggcgtggctaggttacncggctagttcgagtggaancgtatagtgtatancggacgtactaccggtggaaacgggtcctaacgttccaacctatcctaccgaagaanacctaacttaccaaagaacctacgtcttacgtttacacgaactaaaagtcgacgaccgtaagtaccgtaaagaaaacggtaagaaggaccgacggtactagttaaacaagttacgtacgacgggtaccaacggtacgttaaccttaattaaggtttagtacggttacaaggggtcctaaggtttacgacgtaacgggtcgggaccgtacgggtacccgtgaaccgtccgtacctaccgacgtccgaccctaccaacccgg

SEQ ID NO: 355057 - DNA, 669 bp, Homo sapiens
  misc_feature: GZ8MTXP02JZH3J.21.35.D02.1.454.CMB.2.raw
  modified_base (250)..(250): a, c, t, g, unknown or other
  misc_feature (250)..(250): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagttgactttgccatgcacgtgggtcccnccagacctcgaggacgagggctaggaggtggcgtggactagttacncgntagttcgagtaggaagcgtaatagtcgtaacgtagtcggcggtacgtcggggtaggaacgggtcctaactccactactccacgaagaacacctaaactaaccgaaagtacgacgtctttcgttactacgaactaaagtgaacgacgtaacgtaccgtaaaggaaaaggaacgggaacggtacgacgggtattagttaaactaacgttaacgtgggtacgacggtaacggtaaacgttaactttaagttaacgttacgttaggttacgaacgggtactaggttacgtacgtacggacggggaccgtaaccgggtacccgttacggtcccgtaccgttacctacccgtaccgtaccgcccgtacccgaacgg

SEQ ID NO: 355058 - DNA, 705 bp, Homo sapiens
  misc_feature: GZ8MTXP02HSXV0.21.35.D02.1.454.CMB.2.raw
  modified_base (275)..(275): a, c, t, g, unknown or other
  misc_feature (275)..(275): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccactggtggaggtcgggggagcgtgttccagcctgggactcctgagagtctcctgtgcagcctctggattcagtcttcagtntactttcgccatcgcacgtcgggtccacagactccgaggacgaaggggctaggaggtggcgtggctagttacgtccgactagtttcccggagttagggaacgtacgtaagttagttacggttactaggtacggtaccgggtacccgttaccggggtaacggggaaaaccggggttcccggtaaactttaacccgaacccttaacgttcccgtaaccgaagtaaaccgtaaacctaaacgttaacccgaaaagtaaccctaccgttacgtttacggttttaccacgtaaactaaacgttggaaccgacgtaacgacgtaaaggaaaacggaagacggaacgacgggtctaagttaagtaactacggtacgtcgacggtaacggacttaaccgttaagttaacgttcggttacggtacgtacggtaactagg

SEQ ID NO: 355059 - DNA, 689 bp, Homo sapiens
  misc_feature: GZ8MTXP02G4QBT.21.35.D02.1.454.CMB.2.raw
  modified_base (248)..(248): a, c, t, g, unknown or other
  misc_feature (248)..(248): n is a, c, g, or t
  modified_base (290)..(290): a, c, t, g, unknown or other
  misc_feature (290)..(290): n is a, c, g, or t
  modified_base (306)..(306): a, c, t, g, unknown or other
  misc_feature (306)..(306): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccactggtggagtcgggggagcgtgtccagcctgggacgtccctgagagtctcctgtgcagcctcgtggattcagcttcagtgtactttgccatgcacgtgggtccnccagacctcgaggcgaaggggctagagtggctggctagttancgctattcgatggaancgtatatgtactagtcggcggtactccggtaggaaacgggtccaattccacctatcctacgaagaacgacctaacttaaccgaaaagaacctcgtctttagtttactacgtaacgaaaatggaaagacctaacgacgtaaagaaaacgaaagggaacggaaccaagggtactaaggttaaactaacgtaacgtggtacggtaccggtaacggtaaaggtaaccctttaagtttaacgttaaggttaacgggtacgtaaagggtacctaagttacgtaaccgttaacgggtacggggaccgtaaaaccggtaacccggttacggtaacccgtcccgtaaccccgtacccgaccgtacccccgtacccgaaacccggaacccggg

SEQ ID NO: 355060 - DNA, 642 bp, Homo sapiens
  misc_feature: GZ8MTXP02FLBVI.21.35.D02.1.454.CMB.2.raw
  modified_base (247)..(247): a, c, t, g, unknown or other
  misc_feature (247)..(247): n is a, c, g, or t
  modified_base (285)..(285): a, c, t, g, unknown or other
  misc_feature (285)..(285): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccactggtggagtcgggggagcgtgttccagcctgggacgtccctgagagtctcctgtgcagcctctggattcagcttcagtgactttgccatgcacgtcggtccncagactccgaggcaagggctagagtggctggctagtancgcagttcgagtggaagcgtaatagtgtactagtcggacggtaactccggtaggaaacggggtcctagtttaccaccgtatccgtaccgaaggaacgactaacttaaccgaaaaggaacctacggtctttacgttctacgtactaaaagtgaacgacgaacgtacgaaaggaaaacggaaaggacggaacacggtactagtaaataagtaacgtggtacgacgacggtaaggtactttagttacttagtacggttacgaacgggtaactaggttacgaacgttacggacggggaccgtaaccgggacctcggaacctacccgtctaccgtacgaccgtacccgtaaccgaaacccgg

SEQ ID NO: 355061 - DNA, 824 bp, Homo sapiens
  misc_feature: GZ8MTXP02HJTCC.21.35.D02.1.454.CMB.2.raw
  modified_base (254)..(254): a, c, t, g, unknown or other
  misc_feature (254)..(254): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgcctatcgctacgtcgggtcccnccgagacctccaggcgaaggggctagagtggctggacagttatcgactagtttcgagtaggaagcgtaatattaggtaactagtcggacggtacctcggtaggaacggggcctacttaccacctatccctaccgaagtaacggtacctaaacgttacccgaaaagttaaacccaccgggttctttacgggtttaccttacggtaaacctaaaagttcggaacgtaacccgtaacgtacccggttaaaacggaaaaagggaaacggtaaacggggaaacccgtaaaccggggtaccgttaaaggttaaaattaaccgttaaaaccgttcgggttacgggtaacccgaccgggttaaacggttaaccctttttaaagtttaaccgtttaaagggttcgggtttaaaccccggtaaaacggggttacccgttaaaacgggtttaccggtaaaaccgtttaaacccggggacgggggtaaacccgttaacccggggtaaaccccgttcgggttaacccgtacccgttaccgtccccgtaacccgtaccgttacccccgacccgtaaaccccggg

SEQ ID NO: 355062 - DNA, 642 bp, Homo sapiens
  misc_feature: GZ8MTXP02ILVZM.21.35.D02.1.454.CMB.2.raw
  modified_base (248)..(248): a, c, t, g, unknown or other
  misc_feature (248)..(248): n is a, c, g, or t
  modified_base (315)..(315): a, c, t, g, unknown or other
  misc_feature (315)..(315): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccncagactccgaggcaaggggctaggagtggctggctagttatcgctatttcgagtaggaagcgtaatntagtactatggcggtacctccgtgaaaggggccctaattccgaccattcaccagtacacgtaattacccaaaagtaaccacgtcttacgttttaccagaccaaagtgacgtcaacgtaccctaaggaaaagaggaaacggacaacggtacttacggtaataacgttaacgtgtcggaccggtaccgagtaacctttagtaaacttggttacgtagacggtacctagtttacgacgtttacggacggggtaccgtaaccggtaaccgttcgggtaacctaacccggttcttacccggtctaacccggttccctacccggtaaacccgg

SEQ ID NO: 355063 - DNA, 689 bp, Homo sapiens
  misc_feature: GZ8MTXP02JAN0I.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggtattcgagtcttcagtgtactttgcctatcgcacgtcgggtcccaccagacctcgaggcgaaaggggctaggagtggcgtggactaggttatccgactagtttcgagtacgggaagtcggtaatagtagtaacgtagtcggaccggtaccgtcggtaacggtaacggggcctaccttaccgacctattacccgacaaggtacacgtaacttaccgaaaacgacctacgtcgtttagttactagtacaaagtgaacgcgtaacgacgtaagaaaaggacggaaaggaccgtaggttaccgtagttaatactacgtacgtacggaccggtcgtaaacggttaaccctttagttaacggtagttaccgggtacgaaacggggtacctaagtagtaacgtaccgggtacgggaccgtaaaccggtaccgttcggtaacccgccgtttactaccgtaccgtaccgacccctacggaaaccccgg

SEQ ID NO: 355064 - DNA, 680 bp, Homo sapiens
  misc_feature: GZ8MTXP02F35JC.21.35.D02.1.454.CMB.2.raw
  modified_base (251)..(251): a, c, t, g, unknown or other
  misc_feature (251)..(251): n is a, c, g, or t
  modified_base (402)..(402): a, c, t, g, unknown or other
  misc_feature (402)..(402): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtcgggtccnccagactccgaggcgaaggggctaggagtggctggctagttatcgctagttcgagtggaagcgtaatatgtaactagtggcggtactccggtaggaacggggcctaacttccaccatccgtaccagaacgactaaacttaccaaagaaccncgtcttgtttcagacaaatgagcagacctaagaaagaagacggacgacggtactagtaaataactaacgtgtacggacggtacggtaaggttaacctttaagtttaagttacggtttacgggttacgaaacggggttaacctaaggtttacggtaaaccggtttacggggtaccgggggtaacccggtaaaccggggtaaccccggtttacgggtaacccgttaaccccggttccgttccccgtaccgtaccggaccccgttaaccccgaaacccggg

SEQ ID NO: 355065 - DNA, 638 bp, Homo sapiens
  misc_feature: GZ8MTXP02GBIJK.21.35.D02.1.454.CMB.2.raw
  modified_base (250)..(250): a, c, t, g, unknown or other
  misc_feature (250)..(250): n is a, c, g, or t
  modified_base (293)..(293): a, c, t, g, unknown or other
  misc_feature (293)..(293): n is a, c, g, or t
  modified_base (403)..(403): a, c, t, g, unknown or other
  misc_feature (403)..(403): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtcgggtccnccagacctcgaggcgaaggggctagagtcggctggctagttancgcagttcgagtgaagcgatatgtacagtgcgtactcgtagacggtcactcacatcctacagagactacttaccaaacgacacgtcttcgttacacgtacaaagtgaacncgaacgtacgtaaggaaaagaaggacgaacgacgtacgtagttaactaaagttaacgtggtacgaccggtaacgtaacggttactttaagttaaacttaggttacggtaacgtaacgggtaaccttaaggttacgtaaccggttaacggtacggggaacccgtaaaccgggtacccgttacgtaacccgtacccgttacgtccctaaccgaccgtacccgtacccgaaaacccgg

SEQ ID NO: 355066 - DNA, 721 bp, Homo sapiens
  misc_feature: GZ8MTXP02GEGUT.21.35.D02.1.454.CMB.2.raw
  modified_base (251)..(251): a, c, t, g, unknown or other
  misc_feature (251)..(251): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggactccctgagagtctcctgtgcagcctctggattcagtcttcagtgtactttgccatgctacgtcgggtccnccagactccgaggcaaaggggctagagtggctggctagttatcgactagtttcgagtaggaaatcgtaatagtcgtactaagtcggaccggtacttcccggtaggaaaccggggtccctaactttcccaacccgtaattccgtacccgaaaggacgtaacctaaacgttacccgaaaaaggaacctaccggtactttacgtttacacgaactaaaagttgaaacgacgaaacgtacccgtaaaggaaaaacggaaagggaacgaaccgtaaccggggtacctttaaggtaaattaaacgtaaaccgttgggttacgggaccgtaaccgggtaacggttaaccctttaaagttacgttaacgtacgggtttacgaacgggtacctagttacgaacgtaccggtacgggtaccgaacgggtacctacggtaacctacccgtccgtacctacgaccgccctaccgaaacccgg

SEQ ID NO: 355067 - DNA, 716 bp, Homo sapiens
  misc_feature: GZ8MTXP02HYX7P.21.35.D02.1.454.CMB.2.raw
  modified_base (248)..(248): a, c, t, g, unknown or other
  misc_feature (248)..(248): n is a, c, g, or t
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (372)..(372): a, c, t, g, unknown or other
  misc_feature (372)..(372): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgtccagcctgggacgtcctgagagtctcctgtgcagcctctggattcagcttcagtgtactttgccatgctacgtgggtccnccagacctcgaggcgaaggggctaaggagtggcgtggactagttancgntattcgagtggaagcgtatagtagtactagtggaccggtacgtccggtaggaacggggtcctaacttccaacctntcctacagaactactaacttaccaaagaacctacgtctttcgtttaccgagtaactaaagtcgacgaccgaacgtaccgtaaaggaaaaacgggaacggtaacgggaccgtaacgggtacttaacggttaaattaaccgttaaagtgggtacgaaccggtacggtaaacggttaaacccttttaagttaacgtttacggttacggtaacggtaaacgggttaaccttaggtttaccggaaacccgttcggggtaaccgggtaccggtaaaccgggtaacccgttcggtaacccgtacccgttacctcccgtaaccgtacccgtccccgtaaccgaaaccccggg

SEQ ID NO: 355068 - DNA, 726 bp, Homo sapiens
  misc_feature: GZ8MTXP02GR3S0.21.35.D02.1.454.CMB.2.raw
  modified_base (252)..(252): a, c, t, g, unknown or other
  misc_feature (252)..(252): n is a, c, g, or t
  modified_base (296)..(296): a, c, t, g, unknown or other
  misc_feature (296)..(296): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggactccctgagagtctcctgtgcagcctctggattcagtcttcagtgtactttgccatcgctacgtcgggtccnccagacctccgaggcgaagggctaggagtggctggctagttacncgcagttcgagtggaaagcgtaattatagtaactagtcggtccggtaacgtccggtaggaaacggggtcctaactttacccaacctaacgttcccgtaacccaaaggtaacgtaaccctaaacgtttaaacccgaaaacggtaaacccgtaccggttactttcggttttaacctacgaactaaaacgtgaaccgtacgaacgtaccgtaaaggaaaaaggaaacggaacgggaaaccaacgggtacttaaggttaaactaacgttaaacgtcggtacggaaccggtacggtaaacggtttaacctttaagtttaaacgttagttaggttacgaacggttaactagttagacgttaacggtacggggtaaccgtaacgggtaccttcggaaccgtaccgtccgtaccttacaccgttccctaccgaacccg

SEQ ID NO: 355069 - DNA, 652 bp, Homo sapiens
  misc_feature: GZ8MTXP02GQOE8.21.35.D02.1.454.CMB.2.raw
  modified_base (247)..(247): a, c, t, g, unknown or other
  misc_feature (247)..(247): n is a, c, g, or t
  modified_base (290)..(290): a, c, t, g, unknown or other
  misc_feature (290)..(290): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccactggtggagtcgggggagcgtgttccagcctgggacgtccctgagagtctcctgtgcagcctctggattcagcttcagtgactttgccatgcacgtcgggtccnccagactccgaggcgaaggggctaggagtggctggctagttancgactagttcgagtaggaagcgaattatgtactagtcggaccggtacttccgaggaaacgggtcctaattccaacctatccctacaaggaacgacctaaacgttacccaaaagaaaccctaccggtactttcgttttacagaacctaaaagtcgaagtacaaggacctaaggaaaacgaaggaacgggactaacgggcttaaggtaataattaacgtgtacgcgacgtaagtactttaagtattagtgtacgaacggtctaagttcgacgttacggtacggggacctaaacggggtaaccccttgggaaccctaacccggttccttaccccgacgtaccgtaccccgtacccggaaacccgg

SEQ ID NO: 355070 - DNA, 737 bp, Homo sapiens
  misc_feature: GZ8MTXP02IUYAJ.21.35.D02.1.454.CMB.2.raw
  modified_base (252)..(252): a, c, t, g, unknown or other
  misc_feature (252)..(252): n is a, c, g, or t
  modified_base (293)..(293): a, c, t, g, unknown or other
  misc_feature (293)..(293): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagtgtactttgccatgctacgtgggtccnccagacctccgaggcgaagggctagagtggctggcagttancgctagtttcgagtagggaagtcgtaattagtgtactaagtggccggtactccggtaggaacggggtcccaatttcccgaacctagttccctaccgaagaacgtacctaactacccgaaaagtaccgtaccgtcgtttacgtttacagaactaaagtcggactacgtaacgtaccaaggaaaaaggtaacgaacgggaaccgacgggttaccttaagtaaacttaactaacgggttggtaccggacgtaacccggggtaaaggttaaaccctttaagtttaacgtttacggttaaggtaccggaacggtaaacccgtagttttaccggaacgtttacccggggtacgggggtaaccctaaccgggggtaaccccttggggtaacccctaccccggttaccgttccccgtaccgtaaccccggtacccaacccgaaaccccgggg

SEQ ID NO: 355071 - DNA, 680 bp, Homo sapiens
  misc_feature: GZ8MTXP02F4UD9.21.35.D02.1.454.CMB.2.raw
  modified_base (253)..(253): a, c, t, g, unknown or other
  misc_feature (253)..(253): n is a, c, g, or t
  modified_base (280)..(280): a, c, t, g, unknown or other
  misc_feature (280)..(280): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgccaggtccacctggttgaggtcgggggaggcgtgttccagcctgggacgtccctgagagtctcctgtgcagcctctggattcagtcttcagtgtactttgccatgctacgtgggtccnccagctccgaggcgaaggggctaaggngtcggcgtggactagttactcgactagttcgagtaggaagcgtattacgtagtactagtcggaccggtactcggtaggaacggtcctactaccacctactaccacgaagtaacgtactaactaccgaaacgaaccgtacgtcgtttacgttactacgtaaactaaagtcgaacgcgtaacgtaacgtaaggaaaacggaacggaacggaacgacggtaattagtaagttaaacgtacgtaggtacggacggtacgtaacggttaactttaagttaagttacggtacggtacgaacggtactaacgttacggtaacggtacgggtacgggtaacccgtaacgggtacccgtacggtaaccctacccgtcctacccgtacgaccctacccgtacccgaaccg

SEQ ID NO: 355072 - DNA, 798 bp, Homo sapiens
  misc_feature: GZ8MTXP02G0DNA.21.35.D02.1.454.CMB.2.raw
  modified_base (250)..(250): a, c, t, g, unknown or other
  misc_feature (250)..(250): n is a, c, g, or t
tcagtcgtcgctcgcacgaccggtgctcgatttagcacacgatagttgggtttgggggaagaggaagactgacggtcctgccacaggtggtgctgggcacggtgggcactagacacaacatttgcgctccactgtcaggtccacctggtggagtcgggggagcgtgttccagcctgggacgtccctgagagtctcctgtgcagcctctggattcagtcttcagtgtactttgccatgcacgtcgggtccnccagacctcgaggcgaaggggctaggagtggctggctagttatcgctagtttcgagtacggaagcgtaatagtagtaactagtcggacggtacctccggtaggaaacggggtcctaacttccgaacctatcctacgaagtaacgaccgtaaacttacccgaaaagtaacccgtaccgttctttacgtttactacgtaacctaaaaggttcggaaacgacgtaacgtacccgtaaaggggaaaaagggtaacggggtaaacgggaacccgtaacgggttacgttaacggtttaaacttaaacgttaaaccggtgggttaaccgggaccggtaaccgggttaaacggtttaacccgttttaagtttaaacgtttacggtacggggtttaaacggaaaccggggttaacctttaggtttacgtaaacccggttacgggttaacccgggggtacccggttaaaaccggggtaccccgttacgggtaacccccgttacccgttacccgttaccctaccggtaccccgtaccccgttaacccgaaaccccgggg

SEQ ID NO: 355073 - DNA, 634 bp, Homo sapiens
  misc_feature: GZ8MTXP02IX87W.21.35.D02.1.454.CMB.2.raw
  modified_base (264)..(264): a, c, t, g, unknown or other
  misc_feature (264)..(264): n is a, c, g, or t
  modified_base (311)..(311): a, c, t, g, unknown or other
  misc_feature (311)..(311): n is a, c, g, or t
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgcttcttttaagaggtgtccactgtcaggtccacctggtggaggtcggggggaggcgtgttccagcctgggacgtccctgagagtctcctgtgcacgcctntggattcagcttcagtgtactttgcctatcgcaccgtcggggtcccnccgagacctccgaggcgaaggggctaggngtggcgtggctagttncgctattccgatggagcgtatatagtctagtcggaccgtaccgtccggtaggaaacggggtccctacgttaccaccacgtctaccaagaacaactaaacttaaccaaacgaaaccgacgtcttacggtttacacggtaataaacgtgacgacacggtactaaggaaaagaagacggtaacgacggtactaggttaatacgtaaacgtggttacgaccggtacgaacggttaacctttagtttaacgtttacgtacggttacgtaacggtaaccttagg

SEQ ID NO: 355074 - DNA, 583 bp, Homo sapiens
  misc_feature: GZ8MTXP02IQ5GA.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccnccagacctccaggcgaaggggctagagtggactggcagttatcgcattcgatggaagcgatatgtactagtgcggtactccggtgaaacgggccgtattccaccatctccagacactaaattcccaaaaggacctacgctttgtttactagtacaaatgacgcaagcctagaaagaagaaggacgacggactagtataataatgtagacgtcgagtaccttattaagttgttaggtacgaaggtacctagttacgacgttacggacgggtaccgaacgggtaacccgtggtaaccgtacccggtctaccccgtcaccgtccctaccgtaacccgg

SEQ ID NO: 355075 - DNA, 756 bp, Homo sapiens
  misc_feature: GZ8MTXP02IR9BF.21.35.D02.1.454.CMB.2.raw
  modified_base (617)..(617): a, c, t, g, unknown or other
  misc_feature (617)..(617): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcggggggaggcgtgttccagcctgggacgtccctgagagtctcctgtgcagcctcgtggattcagtcttcgagttgtactttcgcctatgctacgtggtccgcagacctcgaggcgaagggctaggagtggctggctagttatcgctagtttcgagtacggaaggcgtaattataggtaacttagtacggtccggtaccgtaccgggttagggaaaccggggtcccgtaaccgtttacccgaaaccctacgttacccgtaaccgtaaaacggaacgtaacccgttaaaaccgtttaaaccccgaaaaacggtaacccgtaaccggttccgttttacggtttttacaaccgggtaaaccttaaaaggtacggtaacgaccgtaaaccggttaccgtaaaaaggggaaaaacgaacgggaccgaaacgggtacgacgttaaggttaataaacgtttaccgggngtacggacgtacggtaacgtttactttaagtacgttagtacggtacgaacggttactacgttacggaccgtacgggcggaccgtaaccggttccgtacgtaacccgtcgtccctacgacgacccgtaccaacccggacg

SEQ ID NO: 355076 - DNA, 603 bp, Homo sapiens
  misc_feature: GZ8MTXP02HZQTM.21.35.D02.1.454.CMB.2.raw
  modified_base (260)..(260): a, c, t, g, unknown or other
  misc_feature (260)..(260): n is a, c, g, or t
  modified_base (304)..(304): a, c, t, g, unknown or other
  misc_feature (304)..(304): n is a, c, g, or t
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccacctggtggaggtcgggggagcgtgttccagcctgggacgtccctgagagtctcctgtgcagcctntggattcagcttcagtgtactttgccagtgctacgtcgggtccnccagacctccgaggtcgaaaggggctaggaggttggcgtggactagttaagtccgatacgttccgagttaggaacgcgtaatagttggtactagttgaccggtactccggtaggaacggccgtattccaacccgtatccgtacaagacgtacctaaattaccgaaagacctacgtacttgtttacagtaccaaagtagactacacgacgtaagaaagagtacgacgacgtacgtagtaactataacgtgtcgacgacgtaggtaacttaattagtacgttaggtacgaacggtactacg

SEQ ID NO: 355077 - DNA, 820 bp, Homo sapiens
  misc_feature: GZ8MTXP02JPCBQ.21.35.D02.1.454.CMB.2.raw
  modified_base (254)..(254): a, c, t, g, unknown or other
  misc_feature (254)..(254): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggaggtcgggggaggcgtgttccagccgtgggacgtccctgagagtctcctgtgcagcctcgtggattcagtcttcagtgtactttgcctatgcacgtcggtccncagcctcgaggacgaaggggctaggagtggctggctagttactcgactagttcgagtaggaagcgtaatagtgtaacgtagtcggaccggtaccgtccggtaggaacgggccgtaattacccaccgtactacctaccgaaagaacgtaacctaaccgttaaaccgaaaaacgtaaccctacggttacctttacggtttaacgtacgaaaacgttaaaggtaccggaagaacccggtaaacggtaacccgtaaaagggaaaaaacggaaacggggtaaccggaaccgtaacgggtaacgttaaggttaaacgtaaaacgttacggtacgggtaccgggaccggttaaccggttaaacgggtttaaaccctttttaagtttaaacggtttaccggtttaagggtaaccggtaaacgggtaacccgttagttaaacccgggtacggttaacgggggtacccggggaacccggtaaaccggggttaacccggttaccgtaacccggtaaccccgtttacccgtaccctaccggtaccccgtacccccggttaacccgaaaacccccgggg

SEQ ID NO: 355078 - DNA, 526 bp, Homo sapiens
  misc_feature: GZ8MTXP02IGUSR.21.35.D02.1.454.CMB.2.raw
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
  modified_base (378)..(378): a, c, t, g, unknown or other
  misc_feature (378)..(378): n is a, c, g, or t
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
  modified_base (422)..(422): a, c, t, g, unknown or other
  misc_feature (422)..(422): n is a, c, g, or t
  modified_base (434)..(434): a, c, t, g, unknown or other
  misc_feature (434)..(434): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagtgactttgccatgcacgtgggtccgccagactccaggcaaggggctagagtggctggcagtatcgctattcgatggaagcgatatgtactatgcgactccgtagaacgggcgattcaccatctcaganactaattacaaagtaaccacgtntntttcngacaaatgancaagctaagaaagaagagagacgctgtanatactgtgacgngagtacttattaattatgtacgaggtactagttgacttagcgggacacgggtaacctggtaaccgacgtctacctcaccgtcctaccaaccg

SEQ ID NO: 355079 - DNA, 798 bp, Homo sapiens
  misc_feature: GZ8MTXP02FHRPD.21.35.D02.1.454.CMB.2.raw
  modified_base (227)..(227): a, c, t, g, unknown or other
  misc_feature (227)..(227): n is a, c, g, or t
  modified_base (298)..(298): a, c, t, g, unknown or other
  misc_feature (298)..(298): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcgggggaggcgtgttccagcctgggacgtccctgagagtctcctgtgcagcctctggattcagcttcagtntactttgccatgcacgtcgggtcccgccagactccgaggcgaaggggctaggagtggctggctaggttacncgctagtttcggattagggaaacgcgtaatagttcgttaactagtcggaccgggtaaccgttcccgggtaagggaaaccggggtcctaaccgtttacccaacccctaacgttcccgtaaccggaaacggaacgtaacctaaaccgttaaccccaaaaaggtaacccgtaacgttcgtttacgttttaccgtagaacctaaaaagttcggaacgaccgtaaacgtacccgtaaaagggaaaaaggaaacggaacggggaaaaccgtaccgggttacgttaaacggttaaacttaaacgttaaaccgtttgggacggtaccggtaaccggttaaacggttaaacccttttaagttttaaacgttaacgttacggggtttacgaaacgggtaaccttagtttacgtaaaccgttacggtacggggacccgaacggggtaaccccgttacggtcccgtaccggttccctacccgtccgaaccggtacccctacccgaaacccgg

SEQ ID NO: 355080 - DNA, 693 bp, Homo sapiens
  misc_feature: GZ8MTXP02GVR1M.21.35.D02.1.454.CMB.2.raw
  modified_base (249)..(249): a, c, t, g, unknown or other
  misc_feature (249)..(249): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtcgggtccnccagacctccgaggcgaaggggctaggagtgggctggctagttacgcgctattcgagtaggaacgcgtaatagtgtactagtggacggtactccgtagaacgggtcctacttccacctatcctaccagaacgactaacttaccgaaagtaacctacgtcttgtttactacgaactaaaagtcgaacgaccgaacgtaccgtaaggaaaagaaacggaacggaaccgtaacggtacttaagttaaacttaaacgttaaacgtggttacggaccgtaacggtaaacgttaaccgttttaaagttaacgtttaacgttagggttaaccgtaaacgggtaaccttagtttacgtaaccggtacggttaccggggaccgtaaaccggggtaccctacggtaaccgtaacccgttccgtacctaccgtaccgacccctaccgaaacccgg

SEQ ID NO: 355081 - DNA, 710 bp, Homo sapiens
  misc_feature: GZ8MTXP02HQEJS.21.35.D02.1.454.CMB.2.raw
  modified_base (298)..(298): a, c, t, g, unknown or other
  misc_feature (298)..(298): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggaggtcgggggaggcgtgttccagcctgggacgtcctgagagtctcctgtgcagcctctggattcagcttcagtgactttgcctatgctacgtcgggtcccgccagacctcgaggacgaaggggctaggagtggcgtggctagttacncgactattcgagtaggaagcgtaatagtagtaactagtcggacggtacctccggtagggaaacgggtccgtacttacccaaccgtactccgtaccgaaaggaacgtacctaaacgttaaaccaaaacgtaaacctaccgtacgtttcgttttaccgagtaaactaaaagtcggaacgaccgaaacgtaccgtaaaggaaaacggaaaggaacgggaacgacggtagttagtaaattaactaacggtgacgggaccggtaaggtaacggttaacctttaagttaagtttgtacgggttaacgaacggggtaacctaggtttacgaacgtacggggtacgggaacccgtaaccgggtacccttggaaccccgttaccgtcctacccgacacccggtaccctaaccgaaacccgg

SEQ ID NO: 355082 - DNA, 589 bp, Homo sapiens
  misc_feature: GZ8MTXP02GGVR0.21.35.D02.1.454.CMB.2.raw
  modified_base (247)..(247): a, c, t, g, unknown or other
  misc_feature (247)..(247): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcactgggtccncagactcaggcaaggggctagagtggctggcagttatcgntattcgatggaancgaatagtgtactagtcgcggtactcgtagaacgggcctattccacctatcctaccgagacgacctaattacccgaaagaaccacgcttagtttacagactaaatgaagcagacctagaaagaaggagacgacggactagtaatataacgtgtagcgacgaagtaccttaattattagttaggtacgaagggtacctagttacgtactacggtacggggaccgtaacgggtaacccgttgggtaaccctacccggttcctccgtacgaccgtacccgtaccaaacccgg

SEQ ID NO: 355083 - DNA, 579 bp, Homo sapiens
  misc_feature: GZ8MTXP02GUM3M.21.35.D02.1.454.CMB.2.raw
  modified_base (250)..(250): a, c, t, g, unknown or other
  misc_feature (250)..(250): n is a, c, g, or t
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
  modified_base (347)..(347): a, c, t, g, unknown or other
  misc_feature (347)..(347): n is a, c, g, or t
  modified_base (376)..(376): a, c, t, g, unknown or other
  misc_feature (376)..(376): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcagggggaggcgtgttccagcctgggacgtccctgagagtctcctgtgcagcctctggattcagcttcagtgactttgccatgcacgtgggtccnccagactccaggcgaaggggctagngtggctggcagttancgcattcgatggaagcgatagtgtactagtgcgactccgagacggcccatcacatcncagagacaatccaaagacacgcttgttcngacaaatgagcagcctaagaaaagaagagaacacggtactagtaataataacgtgtacgacgacggtaacggtaacctttagttaagttagtaggttacgaacggggtacctagttacgaacgttacggtcgggggaccctaacggggtaaccccgtggttacccgaccggttcctaccgtaccgtaccgtcccctaacccgg

SEQ ID NO: 355084 - DNA, 677 bp, Homo sapiens
  misc_feature: GZ8MTXP02JG057.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccgccagactccgaggcaaggggctagagtggctggcagttatcgctattcgatggaagcgaatatggtactagtcggacggtactccggtagaaacggggcctacttccaaccgtatcctaccgaaggtacgtacctaaatttcccaaaaggtaaccctacgtacgtttagtttaccctagtacctaaaagttcgaaacgtccgaacgtaccctaagggaaaaacgtaaacggaacgggaaaccgtaccgggtacttagttaaacgtaacgttaaacgtggttacgaccggtacggtaacggtaacctttaattacgttacgttggttacgaagggtactagttcgtacgtacgtcggggaccgtaacgggtacccgttaggtccgtaaccgttccgtacccgtacgaaccgtcccgtaccgtaaacccgg

SEQ ID NO: 355085 - DNA, 613 bp, Homo sapiens
  misc_feature: GZ8MTXP02GK7WU.21.35.D02.1.454.CMB.2.raw
  modified_base (254)..(254): a, c, t, g, unknown or other
  misc_feature (254)..(254): n is a, c, g, or t
  modified_base (296)..(296): a, c, t, g, unknown or other
  misc_feature (296)..(296): n is a, c, g, or t
  modified_base (601)..(601): a, c, t, g, unknown or other
  misc_feature (601)..(601): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtcccacctggtggagtcgggggagcgtgttccagcctgggacgtccctgagagtctcctgtgcagcctctggattcagtcttcagtgtactttgcctagtgctacgtcgggtccnccaagcctccgaggcgaagggctaggagtggctggctagttncgctagttcggagtggaacgtcgtatagtgtacgtagtcggacggtactccggtaggaacggtccgtacttacccacgtctccgtaccgagtaactactaactaccgaaagacctacgtctttacgtttcagtaactaaagtcggacgtacgtacgacgttaagaaaacgaaggtacggacgtacggtagtacgttaaagtactaaccgtgtacggacgtacgtaacgttatttagtagttagtgtacgaggtacagttcgacgtcgcgggaccgtacgaccgtcgtcgtacctcgtactcgacnccgtaccgaacg

SEQ ID NO: 355086 - DNA, 770 bp, Homo sapiens
  misc_feature: GZ8MTXP02GT70T.21.35.D02.1.454.CMB.2.raw
  modified_base (253)..(253): a, c, t, g, unknown or other
  misc_feature (253)..(253): n is a, c, g, or t
  modified_base (300)..(300): a, c, t, g, unknown or other
  misc_feature (300)..(300): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgactttgcctatcgctacgtcgggtccnccagactcccgaggcgaaggggctaggagtggctggctagttatcgntattcgagtggaagcgtaatatgtactagtcggaccggtacgtccggtaggaaacggggtcctaacgttcccgaacctacgtcctacccgaaggtaacgtaacctaaacctttaccccgaaaaaggtaaccctaccggtcttttacggtttacccgtaagtaacccgtaaaagtcggaacggtaccgaacggtaacccgtaaagggaaaacggtaaaagggaacgggaaaccgtaaccggtacgttaggttaaactaacgttaacggtggtacggaccgtaacgggtaacggttaacctttaagtttaacgttacgttacgggttacggtaaacggggtacccttaagtttacggaaccggttaaccgggttacggggacccggtaaaccgggtacccccgttagggtaacccgtaaccccggttccttaccccgtaccgtacccggtacccctacccggaaaaccccgg

SEQ ID NO: 355087 - DNA, 575 bp, Homo sapiens
  misc_feature: GZ8MTXP02JKGO9.21.35.D02.1.454.CMB.2.raw
  modified_base (247)..(247): a, c, t, g, unknown or other
  misc_feature (247)..(247): n is a, c, g, or t
  modified_base (374)..(374): a, c, t, g, unknown or other
  misc_feature (374)..(374): n is a, c, g, or t
  modified_base (385)..(385): a, c, t, g, unknown or other
  misc_feature (385)..(385): n is a, c, g, or t
  modified_base (395)..(395): a, c, t, g, unknown or other
  misc_feature (395)..(395): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccnccagactccgaggcaaggggctagagtggctggcagttatcgcattcgatggaagcgatatgtactagtgacggactccgtgaacgggcctattcacctatcctcagagacaacttaccaaagaacncgtcttgttcngacaaatgancagactagaaagagagacacggactagtaatactacgtgtacgcgacgaacgtaccttagttatacgtggttacgacgggtaacctagttcgaacgtacggtcggggaccctaacggggtaacccctggggtaaccctaccgttaccgtccgtacgaccgtaccccgtaccgaaccccgg

SEQ ID NO: 355088 - DNA, 596 bp, Homo sapiens
  misc_feature: GZ8MTXP02HVVBQ.21.35.D02.1.454.CMB.2.raw
  modified_base (292)..(292): a, c, t, g, unknown or other
  misc_feature (292)..(292): n is a, c, g, or t
  modified_base (406)..(406): a, c, t, g, unknown or other
  misc_feature (406)..(406): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtccgccagacctccgaggcgaaggggctaggagtggctggcagttancgcattcgatggaagcgatatgtactagtggcgactccggtagaacgggtcctattccgacctatcctaccgagacgacctaaattacccaaagaaaccctacgtcttgtttcngtacaaatgagcagctagaaagagagacacgatagtaataataacgtgtacggcgacggtaacggtaacctttaatttaattagttacggttacgaacgggtactagtttacgacttacggtcggggaccgtacgggtaaccctcggtaaccgtaccgttcctacctacgaccgtccctaccgaacccgg

SEQ ID NO: 355089 - DNA, 522 bp, Homo sapiens
  misc_feature: GZ8MTXP02JYC1A.21.35.D02.1.454.CMB.2.raw
  modified_base (248)..(248): a, c, t, g, unknown or other
  misc_feature (248)..(248): n is a, c, g, or t
  modified_base (346)..(346): a, c, t, g, unknown or other
  misc_feature (346)..(346): n is a, c, g, or t
  modified_base (434)..(434): a, c, t, g, unknown or other
  misc_feature (434)..(434): n is a, c, g, or t
  modified_base (467)..(467): a, c, t, g, unknown or other
  misc_feature (467)..(467): n is a, c, g, or t
  modified_base (508)..(508): a, c, t, g, unknown or other
  misc_feature (508)..(508): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccncagactccaggcaaggggctagagtggctggcagtatcgcattcgatggaagcgtatatgtactatggacgactccggtgaacgggcctattcgaccntcctcaagacgactaattccaaagtacacgtctagtttcagacaaatgagctagactagaaacgaagagacgacggctagatacatgngacgcgagtacttatatagtcgtacaggtactntagactacgcgggacacgggtacctggaactaccgtctccngacgcctacacccg

SEQ ID NO: 355090 - DNA, 665 bp, Homo sapiens
  misc_feature: GZ8MTXP02F1XC0.21.35.D02.1.454.CMB.2.raw
  modified_base (295)..(295): a, c, t, g, unknown or other
  misc_feature (295)..(295): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtcgggtccgccagacctccgaggcgaaaggggctagagtggctggctagttancgactattcgagtggaagcgtatagtgtactagtggcggtactcggtaggaacgggtccgtacttccaccatccgtaccaagacgactaacttaccgaaagaaccacgtcttagttacagtaactaaagtcgagtacaacgtaccgtaagaaaacgaacggaacggaaacgacggtacttaggtaaattaaacgtaacgtggtaccggacgtaacgtaacggttaactttaagtttaattacggttacggttacgaacggtacctaagttcgtaaccgtacgggtacgggtaccgtaaccgggtacccttacggaacccgttaccccgttaccgtacccgtacgtacccggacccctacccgaaacccgg

SEQ ID NO: 355091 - DNA, 667 bp, Homo sapiens
  misc_feature: GZ8MTXP02IPPZI.21.35.D02.1.454.CMB.2.raw
  modified_base (249)..(249): a, c, t, g, unknown or other
  misc_feature (249)..(249): n is a, c, g, or t
  modified_base (272)..(272): a, c, t, g, unknown or other
  misc_feature (272)..(272): n is a, c, g, or t
  modified_base (290)..(290): a, c, t, g, unknown or other
  misc_feature (290)..(290): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccactggtggagtcgggggagcgtgttccagcctgggacgtcctgagagtctcctgtgcagcctctggattcagtcttcagtgtactttgccatgctacgtgggtccncagactcgaggcgaagggctagngtggactggctagttacncgctagttcgatggaacgcgtatagtgtactatcggcgtactcggtagacgggtctacttaccacctactctacgaacgacgtactaactaccgaaacgaacctacggtcttacgtttaccagtacaaagtcgaacgtcgaacgacgtaagaaaacggtaaacgacggacaacgggtattaaaggtaaacttaacgttaaagtcggtacgaccggtacgtacggttaacctttaagttaacgtttagtcgggttaacgaacgggtaaccttagtacggtaaccgttaacgggtcgggtaacccgtaaccgggttacccgttaggaacccgtacccgttacgttacccacgtacccggtacccaccgtaaaccccggg

SEQ ID NO: 355092 - DNA, 728 bp, Homo sapiens
  misc_feature: GZ8MTXP02I3N5N.21.35.D02.1.454.CMB.2.raw
  modified_base (249)..(249): a, c, t, g, unknown or other
  misc_feature (249)..(249): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctcgtggattcagcttcagtgtacttgcctatgcacgtggtccncacgctcgaggcgaaggctagagtgctggcagtatcgctattcgagtaggaagtctaatagtcgtaactagtcgacggtacgtaccggaggaaacggggtccgtaacttaccgacctagttcccaccgaaggaacgaaccttaaacttaacccgaaaacgtaaaccgaccgtcgtttacgttttccgaacgaactaaaagttcgaacgacgtaacgtaccgtaaagaaaaacggaaggaaacgggaaccgtaacggtacgttaaagtaaactttaacgtaacgttacggtcggaccggttaaccgtaaacggttaacctttaaagttttaacgttaaggtttacggtttaacgacggtaaaccttagttacggtaaccgttacgggtaccgggtaccggtaaccggtacccgttacgggtaaccgtaaccccgttccgttacccgtacgtacccgtaccccgtaacccgaaaccccggg

SEQ ID NO: 355093 - DNA, 592 bp, Homo sapiens
  misc_feature: GZ8MTXP02I1054.21.35.D02.1.454.CMB.2.raw
  modified_base (248)..(248): a, c, t, g, unknown or other
  misc_feature (248)..(248): n is a, c, g, or t
  modified_base (346)..(346): a, c, t, g, unknown or other
  misc_feature (346)..(346): n is a, c, g, or t
  modified_base (361)..(361): a, c, t, g, unknown or other
  misc_feature (361)..(361): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccnccagactccaggcaaggggctagagtggctggcagtatcgcatttcgatggaagcgatatgtactagtgcggactcgtgaaggcatcacatctcaganacattaccaagaacncgtctgtttctagacaaatgagcagacctagaaagaagagacacggatagtaatattacgtgtgcgacgtagtaccttaagttattagttggttacgaacggggtaacctagtttacggtaacgttaccggtacgggggtacccgaaacgggggtaacccccttggggtaacccgtaaccccggttccttaccccgtacgtacccgtccccgttaaccccgaaaccccggg

SEQ ID NO: 355094 - DNA, 660 bp, Homo sapiens
  misc_feature: GZ8MTXP02JITW2.21.35.D02.1.454.CMB.2.raw
  modified_base (249)..(249): a, c, t, g, unknown or other
  misc_feature (249)..(249): n is a, c, g, or t
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
  modified_base (415)..(415): a, c, t, g, unknown or other
  misc_feature (415)..(415): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggaggtcgggggagcgtgttccagcctgggacgtccctgagagtctcctgtgcagcctctggattcagtcttcagtgactttgccatgcacgtgggtccnccagactccgaggcaaggggctaggngtgctggacagttanccgactagtttcgagtaggaacgtcgaatagtgtaactagtcggacggtacctcggtaggaaacgggtcctaacttccacacttccaccaaggaacgacctaaatacccgaaagtaacctacgtntttacgtttactacgtacgtaaaagtcgacgacaagtaccgaagaaaaggaacgacggaacgacgtacgtagtaaagtaatacgagtacggacgtacggtaagttacctttagttaacgttagtagttacgaaaggtacctagttacggaacgttacggtacggggaaccgtaacggggtaaccctcggtaacccgtacccgttaccgtacccgtaccgaccgtacccgtaacccgaaaccccgg

SEQ ID NO: 355095 - DNA, 731 bp, Homo sapiens
  misc_feature: GZ8MTXP02J14C4.21.35.D02.1.454.CMB.2.raw
  modified_base (255)..(255): a, c, t, g, unknown or other
  misc_feature (255)..(255): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcgggggaggcgtgttccagcctgggacgtccctgagagtctcctgtgcagcctctggattcagtcttcaatgtactttgcctatgcacgtcgggtcccnccagacctcgaggacgaaggggctaggagtggcgtaggctagttactcgactagttcgagtggaaggtcgtaatagtagttactagtcgaccggtacgtaccggtaggacggtcctacgtaccaccgtactcctacaagaacactaacttaaccgaactaactaccgtcgtttacgttaccgagtaaactaagtacgacgacgtaacgtaacggtaaagaaaacgggaaggaaccggtacgtaccgggtattaaagtaaaccgtaaattacggtacggtacggtaacggtacggtaaacggtttaacctttaagtttaattacgggttaccggtaaggtaaaccgggttacctaggttaccggaaccgtttaacgggggaccggggtaacccgtaaacccggggttacccggttacggtaacccgttaacccgtcccgtaccctaccggtcccgacccgttaacccgaaccccggg

SEQ ID NO: 355096 - DNA, 733 bp, Homo sapiens
  misc_feature: GZ8MTXP02FKZYE.21.35.D02.1.454.CMB.2.raw
  modified_base (252)..(252): a, c, t, g, unknown or other
  misc_feature (252)..(252): n is a, c, g, or t
  modified_base (293)..(293): a, c, t, g, unknown or other
  misc_feature (293)..(293): n is a, c, g, or t
  modified_base (420)..(420): a, c, t, g, unknown or other
  misc_feature (420)..(420): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagttgactttgccatgcacgtcgggtccnccagactccgaggcaaggggctagagtggctggctagttancgctattcgagtaggaagcgaatacgtagttactagtcggacggtacctccggaggaaacggggctacttccaaccgtactccgtaccgaaggtaacaccgtaaacttacccgaaaacggaaaaccnccgtacgtttacggtttaccctaggaaaccttaaaaggtcggaaacgacgtaacgaaccgtaaaggaaaaacggaaacggtaacggaaaccgtaacggtacgttaaggttaaacttaaacgtacgttacggaccgtaccggtaaacgttaaaccggtttaacttttaaagtttagttacggttacgggttaacgaacggttaactacgttacggtaaaccggttacggggtacgggaacccgtaaacggggtacccgtttaggtaacccgtacccgttccgtaccgaccgaccgtacccttacccggaaaccg

SEQ ID NO: 355097 - DNA, 728 bp, Homo sapiens
  misc_feature: GZ8MTXP02GV6SL.21.35.D02.1.454.CMB.2.raw
  modified_base (251)..(251): a, c, t, g, unknown or other
  misc_feature (251)..(251): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagtgtactttgccatgcacgtgggtccncagactcaggcgaagggctagagtggctggctagttatcgctagttcgagtaggaagcgtaatatgtaactagtcggaccggtacgtccggtaggaaacggggtcctaacgttcccaacctatcctaccaaggaacaccgtaaacttacccgaaaacgaaccgtacgtctttagttttccagtactaaaagtgaacgacaacgtacctaaaggaaaacgaaacggaacggaacccgaacgggtacgttaacgtaaattaacgttaaacgtcggttacggacccggtacgtaaaccggttaccttttaagttaacgtttagttacgggttacgaaacggggtaaccttaaggtttacgtaacccggttaaggtaccgggggaacccgtaaaccggggttaacccccgtgggttaaacccccgtacccgttacccgtacccgttaccgaccggttaccccctaaccgtaaacccccggg

SEQ ID NO: 355098 - DNA, 700 bp, Homo sapiens
  misc_feature: GZ8MTXP02JXWYD.21.35.D02.1.454.CMB.2.raw
  modified_base (251)..(251): a, c, t, g, unknown or other
  misc_feature (251)..(251): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (394)..(394): a, c, t, g, unknown or other
  misc_feature (394)..(394): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgccatgcacgtgggtcccncagacctcgaggcaaggggctagagtggctggcagttncgntattcgagtggaagcgtatatgtactagtcggcggtactccggtagacgggccaattccaacctatcctaccgaagacactaaacttaccgaaacgaaaccncgtcctttagtttcctagaacctaaagtgacgtcaacgtaccgtaaaggaaaaggaaacggacgggaaccgaacgggtacttaaggttaaacttaagttaaccgtagggtcggacgtaccggtaaacggttaaccctttaagtttaacgttacggttcggttaaccggaaacggtaccgttaagttagtaaccgttacggggtacggggtaacccgtaaccgggggtaaacccttcggggttaacccgtaccccggttccgttacccgttaccgaacccggtttccccgtaacccgaaccccgggg

SEQ ID NO: 355099 - DNA, 701 bp, Homo sapiens
  misc_feature: GZ8MTXP02GL9ZY.21.35.D02.1.454.CMB.2.raw
  modified_base (251)..(251): a, c, t, g, unknown or other
  misc_feature (251)..(251): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggaggtcgggggaggcgtgttccagccgtgggacgtcctgagagtctctgtgcagcctctggattcagtcttcagtgtactttgcctatgcacgtcgggccncacgactcgaggcgaaggggctaggagtggctggctagttacncgactagttcgagtaggaacgtcgaattagtgtaactagtcggacggtactaccggtaggaaacgggtccgtacttccaccactacctacgaacgaacgacctaaacttacccgaaaagtaacccgtacgtacgtttagtttaccgtagaactaaagttgaacgacgaacgtacgaaaggaaaacggaaaggaacggaacacggtacttagtaaattaacgtaagtggtacggaccggtacgtaacggtttaaccttaagtttaagttagttacgggtacgaaacgggtactaggttaacgacgttacgggacggggtaaccggtaaaccgggtaccgttacgggtaaccctaacccggttcccttacccggaccgtaaccggtaccccgttaaccgaaaccccggg

SEQ ID NO: 355100 - DNA, 778 bp, Homo sapiens
  misc_feature: GZ8MTXP02I4SWV.21.35.D02.1.454.CMB.2.raw
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccactggtggagtcgggggagcgtgttccagcctgggacgtccctgagagtctcctgtgcagcctgtggattcagtcttcagttgtactttcgccagtcgacgtacgtgggtcccaccgaagacctaccgaggacgaaaggggctaggaggtggacgtggactaaggttacgtccgacgtagtttcggaagttacgggaaagacgtaagtttacgtacgtaacgttaagtcggaccgtaccgttaccgggtagggtaaacgggtcctaaccgtttaccgaacctagttaccctaccgaaagaacgtacgtaaaccttaacccgaaaagtaaacccgtacgttaccgtttacgtttaaccgaacgtaaccgtaaaagttccgaaagtacccgtaaaccggtaaccgtaaagggaaaacggaaacgaaacgggtaccgtaacggtaccgttaaaggttaaacttaaacgtacgttacgggtacgtaaccggtacgtaacggttaaacctttagtttaacgtaggttacggtacgaaacggtacctaagttacggaccgttacgggaccggggtacaaccggggtaacctggtaaccccgaaccgttcgtacccgctacccggtacctacccgaaacccgg

SEQ ID NO: 355101 - DNA, 658 bp, Homo sapiens
  misc_feature: GZ8MTXP02I4DTT.21.35.D02.1.454.CMB.2.raw
  modified_base (254)..(254): a, c, t, g, unknown or other
  misc_feature (254)..(254): n is a, c, g, or t
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
  modified_base (638)..(638): a, c, t, g, unknown or other
  misc_feature (638)..(638): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctcgtggattcagcttcgagttgtactttgcctatgcacgtgggtccncagtacctcgaggacgaaggggctaggagtggcgtggctagttancgatagttcgataggacgngtaatagtagtactagtcggaccgtacgtccgtaggaacggccgtattaccacctatcctacgagaagacctaacttaccaaaggacctacgtactttcgtttacaacgtaactaaagtcgaacgacgtaacgtacgtaaaggaaaacgtaacgggacgaaacgtacggttactaaggttaacttaaacgttagcggtaacgggacgaccggtaaggttactttaaagttacttagggtcgtaacgacggtactagtttacggaacgtacggacggggtaccaaccggggtaccttcgtaaccggaccctcgtacccganaccgtcccgtaaccgaacgg

SEQ ID NO: 355102 - DNA, 741 bp, Homo sapiens
  misc_feature: GZ8MTXP02H8BFG.21.35.D02.1.454.CMB.2.raw
  modified_base (253)..(253): a, c, t, g, unknown or other
  misc_feature (253)..(253): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcgggggaggcgtgttccagcctgggacgtccctgagagtctcctgtgcagcctctggattcagtcttcagtgtactttgccatgctacgtgggtccnccaagactccgaggcgaagggctagngngctggcagtancgntatcgagtgaagtcgatatgtactagtcggcgtacgtccggtaggaacgggtccgtagttacccgaactacgtacctaccgaaaggactaaccgtaaattaacccgaaacgtaaccgtaaccgttccgtttagtttacccgaaagtaaactaaaagtcgtaaacggccaaacggtaccgtaaaggaaaaacggaaacggaaacgggtaccgaaccggtacggttaaagttaaattaaacttaaaccggttgggacggaccccggtagggtaaaacccggtttaaactttaaggtttaatacgggttacggttaacggaaaacccgggttactacgtttacggaaacgttaaccggggtcgggtaacccggtaaaacggtccccggtaggtaacccgtaacccggtcttaaccgccgtaaccgtcccccgttaaacgaacccccggg

SEQ ID NO: 355103 - DNA, 694 bp, Homo sapiens
  misc_feature: GZ8MTXP02FL8AX.21.35.D02.1.454.CMB.2.raw
  modified_base (253)..(253): a, c, t, g, unknown or other
  misc_feature (253)..(253): n is a, c, g, or t
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagttgtactttgccatgcacgtgggtcccnccagacctccgaggcgaaggggctaggagtgggctggctagttacncgactagtttcgagtagggaancgtaatagtgtaactagtcggacggtacgtccggtaggaaaccggggtctaacttccaacctatctaccgagaacgactaacttacaaaacgtaacctcgtacgtttcgtttacagactaaaagtgaacgtacgaacgtaccgaaggaaaagaacgggaagaaaccgacggtacttagtaaattaactaaacgtgtacggacggtaacgtaacggttaacctttaagtttaaacgttaggttacggttaacggaacggtaaccgtacgttagaaaccgttacgggacggggtaaacccggaacggggtacccgttacggtcccgtacccggttacctcccgtaaccgtaccgtaccccgaaccgtaacccggg

SEQ ID NO: 355104 - DNA, 712 bp, Homo sapiens
  misc_feature: GZ8MTXP02F1XK5.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagccgtgggacgtccctgagagtctcctgtgcagcctcgtggattcagcttcagtgtactttgaccatcgacacgtcgggtcccaccacgtactccgaggcgaaggggctaggacgtggctggctagtatcgactattacgagtaggaagcgtatagtgtactagtcggaccggtactccggtaggaacgggtcctacgttaccacctacgtacctaccgaagtaacgtacgtaacttacccgaaaacgtaaccgtaccgtctttacgtttacgacgaaactaaacgtggaacgacccgtaagaaccgtaaaggaaaacggaacgggacggaaaccgacgggtagttaagtaaacttaaacgtacggttcggtacggtacggacccggttaaagtaccgttttaagtttaaggttacgtacggttaacggaaacgggttacctaaggtttacgtaccgtacggggttccggggaaacgtacccgggtaccgtcggaacccgttccgtcctacggacggtaccctacccgaccgaacccgg

SEQ ID NO: 355105 - DNA, 713 bp, Homo sapiens
  misc_feature: GZ8MTXP02FRJKH.21.35.D02.1.454.CMB.2.raw
  modified_base (251)..(251): a, c, t, g, unknown or other
  misc_feature (251)..(251): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcgggggagcgtgttccagcctgggacgtccctgagagtctcctgtgcagcctctggattcagtcttcagtgtactttgccatgctacgtggtccncagacctcgaggcaaggggctagagtggctaggactagttactcggtactagtttacgagtacgggaagtcgtaagtacgtaggttaacctagtcggtaccgggtaaccgttccggtaggaacggggtcctaacgtttccccaaccgtacgttaccgtacccgaaggtaacgtaacctaaccgttaaacccgaaaggtaacctaccgtccgtttaggtttccaggtaacaaaagtcgaaagccgaacgtaccaaaggaaaaggaacgaacggtaacgacgtacgtagtaattacgtaacgtcgtacggacggtacgaaccggtttattaatttagtagttacggttacgacggtaaccttagtacgtaccgttaacgacggtaaccggacccgtaaagggtaaaccccgttgtaaacccgttccggtacccttaccggacttaccggacccttaaaccccgg

SEQ ID NO: 355106 - DNA, 734 bp, Homo sapiens
  misc_feature: GZ8MTXP02IUKZC.21.35.D02.1.454.CMB.2.raw
  modified_base (207)..(207): a, c, t, g, unknown or other
  misc_feature (207)..(207): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctntggattcagcttcagtgactttgccatgcacgtgggtccgccagcctccgaggcaaggggctagagtggctggcagttactcgatattcgagtggaagcgtaattgtgtaacttagtcggacggtaccttccggtagggaaacggggccgtactttaccacccgtacttaccgtacccgaaggtaacgaccttaaaacttaccccgaaaagtaaacccgtaccggtcgttttacgggttttaccctagggtaaactaaaacggttcggaaacggaccgtaaacccggacccgttaaagggaaaacggaaacgggaaacgggaaaccgtaccgggtaattacggtttaaactaaagtaccgttagttaccgggaccgtacccggtaaggtacccttaagttaacgttagtacgggttcaaggggtaacctagttacggacttaacggggcgggtaacccgaacgggggtacccttaggggtaacctaacccggttcgtaccctacgacctcccgttaaccgaacccgg

SEQ ID NO: 355107 - DNA, 611 bp, Homo sapiens
  misc_feature: GZ8MTXP02GZWXY.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccncagacctcgaggcgaaggggctagagtggctggctagttatcgctagttcgagtaggaagcgtatatgtactagtgcgactccgtagaacggtccaattccacatcctacaagacgactaattacgaaagacctcgtacttgtttcagacaaatgacgctaagctaagaaagaagaggacacggtattagtaaataacgtaacgtgtacggacgacgtaaacggttacctttaagttaagtttacggtacggttacgaacgggtaaccttagttacgtaacgtacgggtcggggtaccgtaacggggtaaccctgggttaacccaccgttcgtacctacgtaccgcccttaaccgaaacccgg

SEQ ID NO: 355108 - DNA, 615 bp, Homo sapiens
  misc_feature: GZ8MTXP02HHCX5.21.35.D02.1.454.CMB.2.raw
  modified_base (245)..(245): a, c, t, g, unknown or other
  misc_feature (245)..(245): n is a, c, g, or t
  modified_base (270)..(270): a, c, t, g, unknown or other
  misc_feature (270)..(270): n is a, c, g, or t
  modified_base (285)..(285): a, c, t, g, unknown or other
  misc_feature (285)..(285): n is a, c, g, or t
  modified_base (305)..(305): a, c, t, g, unknown or other
  misc_feature (305)..(305): n is a, c, g, or t
  modified_base (409)..(409): a, c, t, g, unknown or other
  misc_feature (409)..(409): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccactggtggagtcgggggagcgtgttccagcctgggactccctgagagtctcctgtgcagcctctggattcagcttcagtgactttgccatgcacgtgggtccnccagactccgaggcaaggggctagngtggctggcagttancgctagttcgaagtggaaancgaatatggtactagtggaccgactcggtaggaaggtcctacgttcaacctagtcctacgaagacgactaaatccaaagaaccagtctagtttccagacaaaancgagcaagctaagaaaacgagacgacacggtactaggtaataagtaacgtggacgacggagtaacggtactttagttaattagtacggttacgaacggacctaagtttcgaaacttacgggacgggtacccgaaacgggtacccctacgggttaacccaacccggttccttacccgtaccgtacggacccctaccgaaaacccggg

SEQ ID NO: 355109 - DNA, 642 bp, Homo sapiens
  misc_feature: GZ8MTXP02JIPZO.21.35.D02.1.454.CMB.2.raw
  modified_base (254)..(254): a, c, t, g, unknown or other
  misc_feature (254)..(254): n is a, c, g, or t
  modified_base (296)..(296): a, c, t, g, unknown or other
  misc_feature (296)..(296): n is a, c, g, or t
  modified_base (422)..(422): a, c, t, g, unknown or other
  misc_feature (422)..(422): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagtcttcagtgtactttgccatgcctacgtcgggtccnccaggacctccgaggcgaaggggctagagtggctggcagttncgtatagtttcgagtaggaagcgtaattacgttttaactaagtcgggacggtaccgtccggtaggaaacggggcctattaccccaccgtatccctacgagaacgtaacacttaccgaaagaaaccncgtcttcgtttacagaactaaagtgacgacgagtaccgtaagaaagaaacggaggaccgaacggcttaagtactaaagtacgtgtcggaccggacgtacgtaaccgtttattacgttagtcgttaacgaggtacctagttacgacgttacggtacgggaccgtacgggaaccttcggtacctaaccgtctacctcgtacggccctaccgaccgtaaccgg

SEQ ID NO: 355110 - DNA, 647 bp, Homo sapiens
  misc_feature: GZ8MTXP02HXEN1.21.35.D02.1.454.CMB.2.raw
  modified_base (273)..(273): a, c, t, g, unknown or other
  misc_feature (273)..(273): n is a, c, g, or t
  modified_base (291)..(291): a, c, t, g, unknown or other
  misc_feature (291)..(291): n is a, c, g, or t
  modified_base (316)..(316): a, c, t, g, unknown or other
  misc_feature (316)..(316): n is a, c, g, or t
  modified_base (343)..(343): a, c, t, g, unknown or other
  misc_feature (343)..(343): n is a, c, g, or t
  modified_base (609)..(609): a, c, t, g, unknown or other
  misc_feature (609)..(609): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgactttgccatgcacgtgggtccgccacgactccaggcaaggggctagngtgctggacagttatcgntagtcgatggaagcgatatgtatangcgactcgaggacggctacttcacctntcctcaaggagacctaattacccgaaagaccgtacgtccttgtttcccagaactaaacgtgaactacagtacccgtaaggaaaacggtaacggacgggaaccgtaacgggtacctagggttaaactaaacgtttaaacggtcgtacgggtacccggacgggtaacgggttaaccttttaaagttaacgttacgttacgggtacgtaaacgggtactacgttacgaacgttacggtcggggaccgtacgggaacccgtcggtaaccnccgttaccgtcctacgacccgtacctacccgaacccgg

SEQ ID NO: 355111 - DNA, 721 bp, Homo sapiens
  misc_feature: GZ8MTXP02IULEB.21.35.D02.1.454.CMB.2.raw
  modified_base (250)..(250): a, c, t, g, unknown or other
  misc_feature (250)..(250): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtgggtccncagactccaggcaagggctagagtggctggctagttactcgactagtttcgagtggaagcgattatagtactagtcgcggacctccgtaggaaacgggtcctattccaaccgtactcctaccaaggtacgtacctaattacccgaaaaggtaaccctaccgtcgtttacgttttacctacgaacgtaaaatgaacgctaacggtacccgtaaggaaaaagggtaaacggaaacgggaaccgaaccgggtacttaagttaaacgttaaacgtttaaacgttcggttacgggaccggtaacggtaacggttaaccctttttaaagtttaaacgtttaggttacggttaacggtaacgggtaaaccttaaggtttaccgtaaaccgttacgggtacggggacccgtaaccggggtaccctacggggtccctacccgttccgtaccgtcgtacccggtacctacccgaaacccgg

SEQ ID NO: 355112 - DNA, 568 bp, Homo sapiens
  misc_feature: GZ8MTXP02HM6E9.21.35.D02.1.454.CMB.2.raw
  modified_base (295)..(295): a, c, t, g, unknown or other
  misc_feature (295)..(295): n is a, c, g, or t
  modified_base (347)..(347): a, c, t, g, unknown or other
  misc_feature (347)..(347): n is a, c, g, or t
  modified_base (365)..(365): a, c, t, g, unknown or other
  misc_feature (365)..(365): n is a, c, g, or t
  modified_base (368)..(368): a, c, t, g, unknown or other
  misc_feature (368)..(368): n is a, c, g, or t
  modified_base (371)..(371): a, c, t, g, unknown or other
  misc_feature (371)..(371): n is a, c, g, or t
  modified_base (373)..(373): a, c, t, g, unknown or other
  misc_feature (373)..(373): n is a, c, g, or t
  modified_base (378)..(378): a, c, t, g, unknown or other
  misc_feature (378)..(378): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (386)..(386): a, c, t, g, unknown or other
  misc_feature (386)..(386): n is a, c, g, or t
  modified_base (432)..(432): a, c, t, g, unknown or other
  misc_feature (432)..(432): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgccatgcacgtcgggtcccgccagacctccgaggacgaaggggctagagtggctggctagtancgctatcgagtggaagcatatagtactagtgcgactcgaggacgcatacacntcacagagacaatacaanacnctntnttcananaatnancagacagaaagaagagactacgagttataataacgtagcgtacggngaccgtaggtaacctttattacggttagttcggtacgtacggtactagttagtaaccgttacgggtacggtaccggacggtaacccgtcggtaaccgtcccgtacgtaccctacgaccgcccgtaaccgaacccgg

SEQ ID NO: 355113 - DNA, 707 bp, Homo sapiens
  misc_feature: GZ8MTXP02FSRM0.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgtactttgccatgcacgtcgggtcccgccagacctccgaggcgaaggggctaaggaggtgggcgtggctagttacgtcgctatttcgagtgggaagcgatatgtactagtggccggtactccggtaggaacggggcctacttaccaccatcctaccgaagaacgacctaaactacccgaaaagtaacctacgtctttacgtttactacgactaaagtcgaacgacaacggtacccaaaggaaaaggtaaacggaggaaaccgtacggtacttaagtaaattaagtaaaccgtggtacggaccggtacggtaacggttacctttaagtttaacgttaacgttcggggtacgtaaaccggggtaaccttagttacggtaaaccgttacgggtcgggggtaacccgtaacggggtaacccgttcggtcccgtaacccggtttaccctcccgtacgtaccgtacccccgtacccgtaaaccccggg

SEQ ID NO: 355114 - DNA, 627 bp, Homo sapiens
  misc_feature: GZ8MTXP02F11BP.21.35.D02.1.454.CMB.2.raw
  modified_base (171)..(171): a, c, t, g, unknown or other
  misc_feature (171)..(171): n is a, c, g, or t
  modified_base (254)..(254): a, c, t, g, unknown or other
  misc_feature (254)..(254): n is a, c, g, or t
  modified_base (299)..(299): a, c, t, g, unknown or other
  misc_feature (299)..(299): n is a, c, g, or t
  modified_base (327)..(327): a, c, t, g, unknown or other
  misc_feature (327)..(327): n is a, c, g, or t
tcagtcgtcgctcgcacgaccggtgctcgatttagcacacgatagttgggtttgggagaggagcccagcactggaagtcgccggtgtttccattcggtgatcagcactgaacacagaggactcaccatggagtttgggctgacctgggttttcctcgttgctcttttaagnggtgtccactgtcaggtccactggtggaggtcgggggagcgtgttccagcctgggacgtcctgagagtctcctgtgcagcctntggattcagtcttcagtgacttgcctatcgcacgtgggtaccccncgagcctcgaggacgaacggggctaggngtggacgtggctagttacgccgatagtacgagtaggagtcgtatagttagtactgcggtaccggtacctacgggtaggaacggccgtacgtaccaaccgtactaccgtacgaagacgactaaacgtaaccgaacgaacgtacgtaccgttacgttcgacgtacgtaaagtacgacgtacgacgtaacgaaggaaaacgaggaacggacgacggtacgtacgtaataacgtacgtaggtacggacgtacggtaacgtaacgtttaacgttaacgttacggtacggtacgaacggtactaag

SEQ ID NO: 355115 - DNA, 729 bp, Homo sapiens
  misc_feature: GZ8MTXP02H2I5O.21.35.D02.1.454.CMB.2.raw
  modified_base (248)..(248): a, c, t, g, unknown or other
  misc_feature (248)..(248): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccnccagacctccaggcaaggggctagagtggctggcagttatcgcatttcgatggaaagcgaatagtgtaactagtggcggactcccggtaggaaacggggccgtaacttccgaaccctatcctaccgaaggaacgacctaaactttacccaaaagtaaaccaaccggtcttagtttttacctagaccaaaagttacggagaccaagacccgtaaggaaaaacggaaaggaaacgggaccgaacgggtaccttaaggttaataaagttaaacgtgggtacgaccggacggaaacgggttaacccttttaaggtttaaacttaacgttagggtttaccgaaaacggggttacccttaaaggtttacggtaaaccgttaaccggtacgggggtaacccgaaccgggggtaacccgttacggggtaacccctaacccggttacctacccgttaccgaaccggtcccccttacccggaaacccccgg

SEQ ID NO: 355116 - DNA, 716 bp, Homo sapiens
  misc_feature: GZ8MTXP02JDP6J.21.35.D02.1.454.CMB.2.raw
  modified_base (254)..(254): a, c, t, g, unknown or other
  misc_feature (254)..(254): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtccctgagagtcctcctgtgcagcctctggattcagtcttcagtgtactttgccatgctacgtcgggtcccnccagacctccgaggacgaaggggctaggaggtggcgtggacagttactccgactagtttacgagtaggaacgcgtaatagtacgtactagtcggaccggtacctcggtaggaacgggcctacttccgacctactccgtacgaagtacgaacctaacgttacccgaaaagtaaccccgtacgttactttacggtttacagaaaccgtaaaagtggaacgtaccgaaggtaccctaaagggaaaacgaacgggaacggaaccgtacgggttaacttagggtaaacttaaacgttacgtcggttaggacccgtaggtaacgtttaactttagtttaacgttagttaggtacgaacggtacctaggttaacgacccggttaggggcccgggaaccgaacgggttacccccgtgggtaaccctaccggtttcctaccgactacccgtcccctaaccggtaaacccgg

SEQ ID NO: 355117 - DNA, 733 bp, Homo sapiens
  misc_feature: GZ8MTXP02FUWAV.21.35.D02.1.454.CMB.2.raw
  modified_base (250)..(250): a, c, t, g, unknown or other
  misc_feature (250)..(250): n is a, c, g, or t
  modified_base (294)..(294): a, c, t, g, unknown or other
  misc_feature (294)..(294): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtcgggtccnccagactccgaggcgaaggggctaggagtggctggctagttacncgactagttcgagtggaaagcgtatagtgtaactagtcggccggtactccggtaggaaacggggtcctacttccaacctatacctaccgaaagaacgacctaaacgttaccaaaacggtaaccctacggtcctttacgggtttacctagaaaccgtaaaacgttggaaacgccgtaaacgtacccgtaaagggaaaaacggaaggaacgggaaaccgtacgggtaccttaaaggtaacttaaacgttaaccgtggttaacgggacccgtaacggtaacggtttaaaccctttaaagtttaacgttaagttacggtttaacgaacgggtaaccttagtttaccgaaccgttaacggttcgggggaaccctaaacgggtacccgttacggtaaccccgtaccgtccttacccgtactaaccggccccgtaccgaaacccgg

SEQ ID NO: 355118 - DNA, 603 bp, Homo sapiens
  misc_feature: GZ8MTXP02H2IW0.21.35.D02.1.454.CMB.2.raw
  modified_base (204)..(204): a, c, t, g, unknown or other
  misc_feature (204)..(204): n is a, c, g, or t
  modified_base (288)..(288): a, c, t, g, unknown or other
  misc_feature (288)..(288): n is a, c, g, or t
  modified_base (406)..(406): a, c, t, g, unknown or other
  misc_feature (406)..(406): n is a, c, g, or t
tcagtcgtcgctcgcacgaccggtgctcgatttagcacacgatagttgggtttgggggaagaggaagactgacggtcctgccacaggtggtgctgggcacggtgggcattcgacacaacatttgcgctccactgtcaggtccactggtgagtcggggagcgtgttccagcctgggacgtccctgagagtctcctgtgcagcctntggattcagcttcagtgactttgcctatgcacgtgggtcccgccagacctccgaggccgagggctagagtggctggcagttacncgactagtcgagtaggaatagtaatagtagtactagtcggacgtacgtaccggaggaacggctacgtaccaactctcgtacgaagtaacgtactaaacgtacaaagaaccgtgtcttnttacacgaacgaaagtagacacgacgtacgaaagaaagaaagacgtacgacgtagttagtaactaagtacgtgacgacgtagtaacgtagtttagtagttagtacgtacgacgtacgtagttacgacgtacgggacgaccgtacggtaccgtacgtaaccgtacccgtacgtccgacgcccgtacccgtaccgaccg

SEQ ID NO: 355119 - DNA, 677 bp, Homo sapiens
  misc_feature: GZ8MTXP02JADVE.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctcgtggtattcagtcttcgagttcgtactttcgcctatcgctacgtcgggtccgccagacctccgaggcgaaggggctaggagtggcgtggactagttatcgctagttcgagtaggaagcgtatatagtacttagtggacggtaccgtccggtaggaacgggtccgtacttccgacctactcctaccgaagacgactaacttaaccgaaacgaaccacgtacttagtttacctagtaacaaacgtagagaccgaacgtaccgaaaggaaaacggaaggaacggaaccgacggtacgttaggtaaactattaaaccgtggtacggcgtaaccgacggttaacttagttaagttgtggttacgacgggtactagttacgacgtacgggtacggggtaccgtaacccggggtaccttaacggtcccgtcccgttaccgtaccttcgaccgtacccccttacccggaaacccgg

SEQ ID NO: 355120 - DNA, 676 bp, Homo sapiens
  misc_feature: GZ8MTXP02FLQNJ.21.35.D02.1.454.CMB.2.raw
  modified_base (292)..(292): a, c, t, g, unknown or other
  misc_feature (292)..(292): n is a, c, g, or t
  modified_base (295)..(295): a, c, t, g, unknown or other
  misc_feature (295)..(295): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagcttcagtgactttgccatgcacgtcgggtccgccagacctccgaggcgaaggggctagagtggctggcagttancgnatttcgatggaagcgatagtgtaactagtggaccggtacgtccggtaggaaacggggtcctaagttcccacctattcctaccgaagtacgacaaattacccgaaagaacccaggttcttcgtttaccgtagtactaaaatgaagtacgaacgtaccgagaaaaacggaaggtaacggaacgaccggtgtagttaataagtaacgtgtacggcgtacggtaggtaaccttaatttaagttagttacgggtttacgaacgggtaacctagttacggtacgttaaccgggtacggggacccgtaaaccggggtaacccgttacggtaacccgtaacccgttccgtaccccttccgaccggtaccccttacccgtaaaccccggg

SEQ ID NO: 355121 - DNA, 692 bp, Homo sapiens
  misc_feature: GZ8MTXP02GU3Q6.21.35.D02.1.454.CMB.2.raw
  modified_base (257)..(257): a, c, t, g, unknown or other
  misc_feature (257)..(257): n is a, c, g, or t
  modified_base (307)..(307): a, c, t, g, unknown or other
  misc_feature (307)..(307): n is a, c, g, or t
  modified_base (359)..(359): a, c, t, g, unknown or other
  misc_feature (359)..(359): n is a, c, g, or t
tcagtcgtcgctcgcacgaccggtgctcgatttagcacacgatagttgggtttggggggagaggagcccagcactggaagtcgccggtgtttccattcggtgatcagcactgaacacagaggactcaccatggagtttgggctgacctgggttttcctcgttgcttcttttaagaggtgtccactgtcaggtccactggtggaggtcgggggagcgtgtccagcctgggacctcctgagtagtctctgtgcagcctntggtattcagtcttcgagtcgtactttgcctatcgctacgtcgggtcccnccgagacctcgaaggacgaaggggctaggaggtcggacgtggactagttacncgactacgttaccgagtaggaaagcgtaattacgtagtacgtagcgggtaccgtaccgttccgggtaaggaaaccgggtccgttaaactccgaaaccctactcccgtaaccgaaaggtaaacgtaaccttaaaacgttaacccgaaaacggaacccgtaacgttccgtttacggtttacacggtaactaaaagtcggaaacaccgtaacgaccgtaaagggaaaacgacggaacgaccgacgggtacttaggtaataacgtaacgtcggtacgaccggtacgtaacgttaactttagtaacgtttacggtacgtacggaaccgtacttaacgg

SEQ ID NO: 355122 - DNA, 655 bp, Homo sapiens
  misc_feature: GZ8MTXP02IDVD8.21.35.D02.1.454.CMB.2.raw
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagtgacttttgcctatgcacgtgggtccgccagacctcccgaggcgaaggggctaggagtggctggctagttancgctntttcgatggaagcgatatagtactatcggcggactccgtagaacggggcgaccttccaccatctaccaagacgacctaaacgttaccaaacgtaaacaccgtcttagtttccagtacaaatagagacacgactaagaaagaaagacggtaacgacggtactaggttaataacttaacgtggacggtcgacggtaaggttactttaattaagttagttacggtacgtaacgggtaactacggtttacggtacttaaaccgggtcggggaccgtaaccggggttaacccgtcgggttaaccctacccggttaccttccccgtaccgtacccggtacccctaacccggaaccccgg

SEQ ID NO: 355123 - DNA, 713 bp, Homo sapiens
  misc_feature: GZ8MTXP02GJCRS.21.35.D02.1.454.CMB.2.raw
  modified_base (573)..(573): a, c, t, g, unknown or other
  misc_feature (573)..(573): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggacttcagtcttcagttgtactttgccatgctacgtcgggtcccgccagacctccgagggaccgaaggggctaggtaggtcgggcgtggctagttacgtccgactagttcgagtaggaacgagtaatagttacgtactagtcggaccggtactaccgggtagggaaacgggtccgtaacttacccgaacctacttacccgtaccgaagtaaccgtaacctaaccgttaaacccgaaaacgtaaccgacccgttctttacgtttacacggaaactaaaacgtgaacgaccgtaacgtaccgtaaagggaaaacgaacggggaacgaaacccgacggtacgttaaagttaactacgttaaacgngggttacggcgacggttaaagttactttagttagtggttacggtacgacgtactagtttacgacgttaacgggcggtaccggtaccgaccgttcggtaacccgtaccttctacccgtgaccctacccgtacgaaccccgg

SEQ ID NO: 355124 - DNA, 817 bp, Homo sapiens
  misc_feature: GZ8MTXP02FX6EB.21.35.D02.1.454.CMB.2.raw
  modified_base (253)..(253): a, c, t, g, unknown or other
  misc_feature (253)..(253): n is a, c, g, or t
tcagtcgtcgctcgcacgaccggtgctcgatttagcacacgatagttgggtttgggggaagaggaagactgacggtcctgccacaggtggtgctgggcacggtggacactcgacacaacatttgcgctccactgtcaggtccacctggtggaggtcgggggaggcgtgttccagcctgggacgtccctgagagtctcctgtgcagcctctggattcagtcttcagtgtactttgcctatgcacgtcgggtccncagacctccgaggcgaaggggctaggagtggcgtggactagttagcgtctagtttcgagtaggaacgtcgtaattagttacgtaacgttagtcggtaccgggtacccgttccggggtaagggaaaccggggtaccttaaccttacccgaacctacgttaccctaccgaaacgtaaacgtaacccgtaaacttaaacccgaaaaacgtaacccgtaccgttaccgtttacggttttaccaacggtaaaccttaaaaaggtccggaaacggaccgtaacggttaacccgaaaaggggaaaaacggaaacggggttaaccggaacgtacgggtacgttaaagttaaaattaaccggttaagtcgggtacgggaccggtaaccggttaaacgggtttaaccttttaagtttaaggttacggttacgggttaaccgaacgggttaaccttaggttacggtaacccgttagggggtacccggggaacccgttaaacggggtccccgtttacggaacccctaaccggttcccttaccgaccgtaccgaccccgttaccccgaaacccgggg

SEQ ID NO: 355125 - DNA, 695 bp, Homo sapiens
  misc_feature: GZ8MTXP02JDU0U.21.35.D02.1.454.CMB.2.raw
  modified_base (249)..(249): a, c, t, g, unknown or other
  misc_feature (249)..(249): n is a, c, g, or t
  modified_base (289)..(289): a, c, t, g, unknown or other
  misc_feature (289)..(289): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgcacgtgggtccnccagacctccagacgaagggctagagtgctggctagttancgcagttcgatggaacgcgaattagtagtactagtcggacggtactccggtagaaacggggcctaagttccaaccgtatcctaccgaaggtaacacctaaacgttacccaaaggtaacccaccgtcgtttacgtttactacgtaactaaaacgtgaacgacgtaacgtacctaaaggaaaagaaacggaacggaaccgacggtacgttagtaaacttaaacgttacgtacgttggaccgtacggtaacgtaacctttaagtttaagttacgtaggttacgaacgggtaacctagttacggtaaaccgttacggtaacgggggtacccgaaacggggttaccccggttacggtcccgaccgtttacccgtaccggttaccaccggttacccctaccgaaaccccggg

SEQ ID NO: 355126 - DNA, 746 bp, Homo sapiens
  misc_feature: GZ8MTXP02FJZ8M.21.35.D02.1.454.CMB.2.raw
  modified_base (210)..(210): a, c, t, g, unknown or other
  misc_feature (210)..(210): n is a, c, g, or t
  modified_base (253)..(253): a, c, t, g, unknown or other
  misc_feature (253)..(253): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagccctntggattcagtcttcagtgtactttgccatgcacgtgggtcccnccagactccgaggcgaaggggctagaggtggctggctagttatcgctagttcgagtggaaagtcgaatatgtactagtggacggtactccggagaacgggctattccaccatctacagagacctaactaccaaagaacctacgtactttgtttactagaactaaaagtcgaaacgcgaaacggtaccgtaaagggaaaaacggaaacggggaacgggaaacccgtaacggggtaccgtttaaggttaaaacgtttaaaccgttaaacgttcgggttaacgggacccgtaacccggggttaaaccgggtaaacccctttttaaagtttaacgtttaaacggttccggggtttaaacgaaacggggtaacccttaaggttacggtaaaccgttaccgggttaccgggggacccgtaaacgggggaaaccccctttggggaacccctaacccggttaccgttacccaccgtaacggtccccctaccgaaaccccgg

SEQ ID NO: 355127 - DNA, 711 bp, Homo sapiens
  misc_feature: GZ8MTXP02IXLXQ.21.35.D02.1.454.CMB.2.raw
  modified_base (251)..(251): a, c, t, g, unknown or other
  misc_feature (251)..(251): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagcttcagtgtactttgccatgccacgtcgggtcccnccagacctccgagggcaaggggctaggagtggcgtggctaggttactcgactagtttcggagtaggaagtcgtattagtgttaactagtcggcggtactccggtaggaaacggggcctattaccacctatcctacgaagaacgtacctaaattacccgaaaagtaacccgtacgtctttacgtttactacgaactaaaagtacgaacgacgaacgtaccgtaaaggaaaaggaaggaacgggacgacggtacgttaagtaaacttaaacgttaacgtaggtacggtaccgaacggtaacggttacctttaagtttaagttaagttacggttaaccgacgggtaaacctagtttacgaaccgtttaacggaccgggggtaccgtaaaccggggtaacccgttcgggtaaccgtacccggttacctcccgtaccgtaaccgtccccgtaacccgaaacccgg

SEQ ID NO: 355128 - DNA, 542 bp, Homo sapiens
  misc_feature: GZ8MTXP02FV396.21.35.D02.1.454.CMB.2.raw
  modified_base (317)..(317): a, c, t, g, unknown or other
  misc_feature (317)..(317): n is a, c, g, or t
  modified_base (328)..(328): a, c, t, g, unknown or other
  misc_feature (328)..(328): n is a, c, g, or t
  modified_base (353)..(353): a, c, t, g, unknown or other
  misc_feature (353)..(353): n is a, c, g, or t
  modified_base (428)..(428): a, c, t, g, unknown or other
  misc_feature (428)..(428): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccgccagctccaggcaaaggggctagagtggctggcagttatcgcatttcgatggaagcgatatgtactangcggactccgngaagggcgattcaccatctccaganacaatccaaagaaccacgctgtttctgacaaaatgaagcagccagaaaagaagagacacggctagaatataaacngtagcgcgtaaggaccctttaagttattataggttcaaggggaaccattagaactacgtcggggaccacggggaacccctggaaccaccgtcgacctcacgccctccaaacccg

SEQ ID NO: 355129 - DNA, 733 bp, Homo sapiens
  misc_feature: GZ8MTXP02JGH8X.21.35.D02.1.454.CMB.2.raw
  modified_base (248)..(248): a, c, t, g, unknown or other
  misc_feature (248)..(248): n is a, c, g, or t
  modified_base (291)..(291): a, c, t, g, unknown or other
  misc_feature (291)..(291): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggagcgtgttccagcctgggactccctgagagtctcctgtgcagcctctggattcagtcttcagtgtactttgccatgcacgtgggtccncgagcctccgaggcgaaggggcaggagtggctggactagttancgactagtttcgagttggaacgtcgaattagtcgtactagtcggacggtacctccggtaggaaacgggtcctaactttcccgaaccgtacttccgtaccgaaagtacgtacctaaacttaacccgaaacgtaaccgtacgttctttacgtttaccagaaactaaagtacggactaccgaagtacctaaaggaaaaggtaagaaccggaacgaacgtacgtagttaaattaaacgtaagttcggtacggaccgtaacgtaacgttaaccctttaagtttaagtacggttaacgggttccgaaacgggttacccttaggtttaccgaaaccgggttaccgggttaacgggggtaccccgtaaaaccggggtaccccttaggggtaaccccttaacccgggtccttcccggaaacctacccggtcccccttaacgaaaccccggg

SEQ ID NO: 355130 - DNA, 659 bp, Homo sapiens
  misc_feature: GZ8MTXP02JLB09.21.35.D02.1.454.CMB.2.raw
  modified_base (252)..(252): a, c, t, g, unknown or other
  misc_feature (252)..(252): n is a, c, g, or t
  modified_base (275)..(275): a, c, t, g, unknown or other
  misc_feature (275)..(275): n is a, c, g, or t
  modified_base (293)..(293): a, c, t, g, unknown or other
  misc_feature (293)..(293): n is a, c, g, or t
  modified_base (641)..(659): a, c, t, g, unknown or other
  misc_feature (641)..(659): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccactggtggagtcgggggagcgtgttccagcctgggacgtccctgagagtctcctgtgcagcctctggattcagtctttcagtgtactttgccatgctacgtgggtccacngactccgaggcgaagggctaggngtggcgtggctagttacncgtctagttcgaagtaggaacgcgtaatagtcgttaacgtagtcggtacggtaccgttacggtaggtaaacgggtcctaacccgttacccaccgtacttaccgtaaccgaaggtaaacgtacctaaaacgtttaaccgaaaaaccggtaaacccgtaccgttaccgttttacgtttttaacccgtacgttaaaaccgtaaaacggttccggtaaaaccggtaaccgtaaaacccggggttaacccgaaaacggggtaaaaaaaacgggggtaaaacccgggggttaaaccggggtaaacccccggtaaacccgggggttaaaacccggttttaaacgggttttaaaannnnnnnnnnnnnnnnnnn

SEQ ID NO: 355131 - DNA, 763 bp, Homo sapiens
  misc_feature: GZ8MTXP02FKJ0F.21.35.D02.1.454.CMB.2.raw
  modified_base (264)..(264): a, c, t, g, unknown or other
  misc_feature (264)..(264): n is a, c, g, or t
  modified_base (310)..(310): a, c, t, g, unknown or other
  misc_feature (310)..(310): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccactggtggagtcgggggaggcgtgttccagcctgggacgtccctgagagtctcctgtgcagcctgtggattcagcttcagtgtactttgccatgctacgtgggtccgccagacctccaggngaagggctagagtggcaggctagttatcgctattcgagtaggaagngtatatgtactagtggcggtactccggtaggtaaacgggcctaacgtttcacccgtattccggtaccaaggaacgacctaaacgttacccgaaagaaaccgtaacccgtcgtttacgggttttactacggtaacaaaaaccgttgggaaacgtaccgaaaccggtcgtaaacggaaaaaaaggaaaccggaaggggtaaaacccaacgggggtactacgttaaaacgttaaagttaaaccgtggtagggaccgaaccggtaacgggtaaccctttaaatttacggttaccttggggttaacccgaacggggtaacctaaggtttacggtaaacgttaaacggtccgggggtaacccccgtaaaacgggggtacccccgttagggggtaacccctaaccgtttcccggtccccttaaccggtaaccggtccccgtaaccccctaaaaccccggg

SEQ ID NO: 355132 - DNA, 838 bp, Homo sapiens
  misc_feature: GZ8MTXP02FF92T.21.35.D02.1.454.CMB.2.raw
  modified_base (297)..(297): a, c, t, g, unknown or other
  misc_feature (297)..(297): n is a, c, g, or t
  modified_base (302)..(302): a, c, t, g, unknown or other
  misc_feature (302)..(302): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgcctatgcacgtcgggtccgccagcctccgaggcgaaggggctaggagtggctggactagttacncgtanagttcgagtaggaacgcgtatacgtagtactagtcggaccggtaccgttaccggaggaaaccggggtcctaaaccgtttcccgaaccctagttacccgtaccgaacggaacgtaacctaaaccttaacccggaaaacgtaaacccgtcggttactttacgggttttaccaaagggtaaacctaaaacggttcgggaaacgttaccgaaacgtacccgtaaaaggtaaaaacgggaaacgggtacggaaaccccgtaacgggttaccgttaaacgttaaaacgtttaaccgtaaaccgggttcgggttacgggaaccggggtaaaccggttaaccggtttaaaccctttttaaagtttaacggttacggtacggggtttaaccggaaaccggggttaacccttagggttaccggtaaacccggtacgggggtacccgggtaaccccggtaaaccggggtacccccgttaggtaacccccggtacccttacccgtccccgttacggaccccgtaccccgtacccgaaaacccccgggg

SEQ ID NO: 355133 - DNA, 636 bp, Homo sapiens
  misc_feature: GZ8MTXP02FI978.21.35.D02.1.454.CMB.2.raw
  modified_base (254)..(254): a, c, t, g, unknown or other
  misc_feature (254)..(254): n is a, c, g, or t
  modified_base (295)..(295): a, c, t, g, unknown or other
  misc_feature (295)..(295): n is a, c, g, or t
  modified_base (539)..(539): a, c, t, g, unknown or other
  misc_feature (539)..(539): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggaggcgtgttccagcctgggacgtccctgagagtctcctgtgcagcctctggattcagtcttcagttgtactttgccatgcacgtcgggtcccnccagactccgaggcaagggctagagtggctggctagttacnccgatacttacgagtaggaagtcgaatatgtaactagtcggaccggtactcccggaggaaccgggtacctacttaccgaacctatcctacgaagaacgactaaacgtaccaaagaacctacgtacgtttgtttcacgtaaactaaaagtcggaagtaccgaacgtaaccaaggaaaaacgaaacggacgaacgcgtactaagtaataacgtagtcgtaacgcggtacgtagttacttaagttanggtagtacgaagtacctagttacgacgtacgggtcggaccgtaacgggtacctcgtcccgacgttcccgttacaccgtacgcccgtacgaaacccgg

SEQ ID NO: 355134 - DNA, 647 bp, Homo sapiens
  misc_feature: GZ8MTXP02FENLA.21.35.D02.1.454.CMB.2.raw
  modified_base (250)..(250): a, c, t, g, unknown or other
  misc_feature (250)..(250): n is a, c, g, or t
  modified_base (293)..(293): a, c, t, g, unknown or other
  misc_feature (293)..(293): n is a, c, g, or t
  modified_base (627)..(627): a, c, t, g, unknown or other
  misc_feature (627)..(627): n is a, c, g, or t
tcagtcgtcgctcgcacgaccggtgctcgatttagcacacgatagttgggttggggggaagaggaagactgacggtcctgccacaggtggtgctgggcacggtgggcactcgacacaacatttgcgctccactgtcaggtccacctggtggagtcggggggagcgtgttccagcctgggacgtccctgagagtctcctgtgcagcctctggattcagcttcagtgtactttgccatgcacgtcgggtccnccagctccgaggcgaaggggctagagtggctggctaggttacncgactagttagagtaggaagcgtaatagtagtaactagtcggacggtacctccggaggtaacggtcctacttaccaactactccgtacgaagaacgtacctaaactaccaaaagtaccgtacgtctttacgtttactagtaacgtaaagtcgaacgacgtaacgtacgaaaggaaaacggtaacggacggaaccgtacggtactaagtaacttaacgtacgtggtacggacggtacggtaacgttaactttaagttacgttaaggtacggttacgaacggtactagtacgaacgtacggcgggaccgtaacggaccgtgtaacccgtacgtccncctacacgcctaccgaaccg

SEQ ID NO: 355135 - DNA, 664 bp, Homo sapiens
  misc_feature: GZ8MTXP02G67QU.21.35.D02.1.454.CMB.2.raw
  modified_base (252)..(252): a, c, t, g, unknown or other
  misc_feature (252)..(252): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtcgactttgccatgctacgtcgggtccnccagacctccgaggcgaaggggctaggaggtggctggctagttactcgctagttcgagtaggaagcgaatagtagtaactatcggcggtacctacggtaggaacgggcaacgttccacctactcctaccgaagaacgacctaaactaccgaaagtaacaccgtacttgtttactagaactaaagtgacgtacaacgtacgtaaacgaaaggaaacgaacggtaaccgacggtacctaagtaaacttaagtaacgtagtacggacggtaacgtaacggtactttaagtttaacgtttagttcggtaacgtacgggtacctagttacggaacgttacggtacgggaccgtaaccggtaacccgtcggtaaccgtaccgtaccctaccgtacgaaccgtaccctacccgaaccgg

SEQ ID NO: 355136 - DNA, 573 bp, Homo sapiens
  misc_feature: GZ8MTXP02I5WJQ.21.35.D02.1.454.CMB.2.raw
  modified_base (249)..(249): a, c, t, g, unknown or other
  misc_feature (249)..(249): n is a, c, g, or t
  modified_base (288)..(288): a, c, t, g, unknown or other
  misc_feature (288)..(288): n is a, c, g, or t
  modified_base (303)..(303): a, c, t, g, unknown or other
  misc_feature (303)..(303): n is a, c, g, or t
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcggggggaggcgtgttccagcctgggacgtccctgagagtctcctgtgcagcctctggattcagcttcagtgactttgccatgcactgggtccnccagactccaggcaaggggctagagtggctggcagttancgcattcgatggaancgatatgtactatgcgactccgtgaaggccgattcaccatctcagagcaattccaagacacgntgttctgcaaatgacnagactagaaagagaaggacacggtcagttatattaactcgtagcgcggaggtaccttattaacttagttagttacgacgggtaaccgcgtttaggaacctttacgcgggggtacctaacgggggtaaaccccttcggggtaacctacccggttacctcccttaccgaccggtccccttaacctaaccccgg

SEQ ID NO: 355137 - DNA, 638 bp, Homo sapiens
  misc_feature: GZ8MTXP02F1IU7.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcgggggaggcgtgttccagcctgggacgtccctgagagtctcctgtgcagcctctggattcagtcttcagtgtactttgcctatgcacgtcgggtccgccagtactcgacggacgaaggggctaggaggtcggctggctagttatcgctattacgagtaggagcgtatagtcgtactagtcggacggtaccgtccggtaggaaccggggtacctacgttaccaacctagtccaccgaagaacgactaacttaaccgaaacgaacctactcgtttcgttactacgaactaaagtcgacgtacgaacgtaacctaaagggaaaacgaaaggacgaaaccgtacgtacgttaaagtaaagtaacttaacgtcggtacggaacggtacgtaacggtttattatttaagtacggtacgttagaaccgtatagttcgacgttacggcggacgaacggtctcgaactcgtactcgcgctccacgaaccg

SEQ ID NO: 355138 - DNA, 773 bp, Homo sapiens
  misc_feature: GZ8MTXP02F80O4.21.35.D02.1.454.CMB.2.raw
  modified_base (187)..(187): a, c, t, g, unknown or other
  misc_feature (187)..(187): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccacctggtggagtcgggggaggcgtgttccagcctgggacgtcccngagagtctcctgtggcagcctctggattcagtcttcacgtggtactttgccatgctacgtcgggtcccgcacgtacctccgaggcaaggggctaggagtggctggctagttagtcgctaagtttcgagtggaaacggtcgtaagtagtaggttaacttaacgtcggtaccggtacgttacccggtagggtaaaccggggtccgtaaagtttcccgaaaccctaacttcccctacgaaaccggtaacgtaccgtaaacgttaacccgaaaacgtaaaccctccgttaaacgtttgtttttcccaaacgttaaccgaaaaaggttcgaaacggtacgaaccgtacccgtaaaggaaaaaggaacggtaacgggaaccgagtaacgttacggaaattactaaacgttcggacggaccgacgggtaaggttacccttaagttttaacgttaggtttacgggttacgtaaacgggtaccttaaggtaccgttaaacggtacgggttaccggggaccgtaaaccgggggtaaccgttcggtaaccgtacccggttctaccccgttacgaccgttcccgacccgtaaacccgg

SEQ ID NO: 355139 - DNA, 716 bp, Homo sapiens
  misc_feature: GZ8MTXP02GHK0V.21.35.D02.1.454.CMB.2.raw
tcagtcgtcgctcgcacgaccggtgctcgatttagcacacgatagttgggtttgggggggagaggagcccagcactggaagtcgccggtgtttccattcggtgatcagcactgaacacagaggactcaccatggagtttgggctgacctgggttttcctcgttgctcttttaagaggtgtccactgtcaggtccaccgtggtggaggtcgggggagcgtgttccgagccgtgggacgtcccgtgagacgtctcctgtgcagcctcgtggtattcagtcttcagtcgtactttgacctagtcgactaccgtcggggtccccgaccgagaccgtccgaagggaccggaaacggggtctaggaggttcgggcgttacgggcttaggttaacgtcgacttagtccgagtagggaagtcgtaattagttacgtacgtagtcggtaccggtaccgttacccggtagggaacgggtccctaacgtaccgtaaccctacgtaccgttaccaaacgaacgaacctaaacgttaaacccgaaacgaaaccgtaccgtacgttacgtttacgtacgtacaaagttacgacgaccgtacgaccgtaagaaaaggtaacgacggaacggacgtaccgttagtaaagtaactacggttacgcggtaacgtacggtagtaacgtttaacttaggttacgttacggttacggtaacggttaacccgttaagg

SEQ ID NO: 355140 - DNA, 673 bp, Homo sapiens
  misc_feature: GZ8MTXP02JTA77.21.35.D02.1.454.CMB.2.raw
  modified_base (253)..(253): a, c, t, g, unknown or other
  misc_feature (253)..(253): n is a, c, g, or t
  modified_base (300)..(300): a, c, t, g, unknown or other
  misc_feature (300)..(300): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgtccagcctgggactcctgagagtctcctgtgcacgcctcgtggattcagtcttcagttgtactttgccatcgctacgtcgggtccncacgacctccgaggcgaaggggctaggagtgcgtggcagttagcganagttcgagtaggaatcgatagtagtactagtcgacggtactcgtaggaacggtcctagttacccgacctagtccctacgaagtacgaacctaattaaccgaaaacgtaccgacggttctttagttcctaagaactaaagtagacgactaacggaaccgtaaggaaaacggaacggaacggtacccgacggtacgtagttaaagtaacgtaacgtggtacgggaccgtacggtaaacgttaacgtttattaacgttacggttacggtacgaaacgggtactaagttcggtaaccgtacggtaccggggaaccgaaccgggttaacgtcggtaaccgtaccccgtctccggtaccaccgtcccgacctaacccgg

SEQ ID NO: 355141 - DNA, 708 bp, Homo sapiens
  misc_feature: GZ8MTXP02JX6TD.21.35.D02.1.454.CMB.2.raw
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggaggtcgggggaggcgtgttccagcctgggacgtccctgagagtctcctgtgcagcctctggattcagtcttcagtgtactttgccagtgcacgtcgggtcccgccacgtactcccgaggacgaagggctagagtggtcgtaggctagttacgtcgctattcgataggagcgtatatcgtactagtcgacggtactcgtaggacggtcgtacctaccactactcctacgagacactaactacaaacgacaccgtcgttacttactagaaccgtaaatacgaacgtaccgacgtaccctaaaggaaaaggaaacgtaacgggaccgtaacgtacgtacgttaaattaacgtaacgtaggtacggtaccggacggtaaacggttaccttttaagttaacgtttaggttacggttacggtaacgggtaccgtaagttcggtaaccggttaacgggtccgggtaacccggttaaacccgggtacccggttacgggtaacccgttacccgttacccgttaccctacccggtacccgtacccgttaaccccggtaaaccccgg

SEQ ID NO: 355142 - DNA, 719 bp, Homo sapiens
  misc_feature: GZ8MTXP02HE333.21.35.D02.1.454.CMB.2.raw
  modified_base (294)..(294): a, c, t, g, unknown or other
  misc_feature (294)..(294): n is a, c, g, or t
  modified_base (310)..(310): a, c, t, g, unknown or other
  misc_feature (310)..(310): n is a, c, g, or t
tcagtcgtcgctcgcacgaccggtgctcgatttagcacacgatagttgggtttggggggaagaggaagactgacggtcctgccacaggtggtgctgggcacggtgggcactcgacacaacatttgcgctccactgtcaggtccacctggtggagtcgggggagcgtgttccagcctgggacgtccctgagagtctcctgtgcagcctctggattcagtcttcagtgtactttgccatgcactggtcccgcaggcctcgaggcaaggggctagacgtggctgggctagttagtcncgtattcgataggacncgtaattatcggtacttatggacgtacgttccggaggaaggccgtaacttccgaaccacgttccgacaaggtaacgtctaaacttaccaaacgtacaaccgtctttagtttcgaagaccttaaagtgaacggtacacgaaccttaggaaaaggaagaacgggttacaccgggtactaagttaaaggttaaaccgttactaacggttgggacccgaggtaacgggttaaccctttaaacgttttaacgtaggtttacggggttaaccccgaagggggttaaaccccctcgtttaaggttacccccgaaggtttacccggggggtaaccccaacggggtaaacccccgttttggaacccccgttaaaccgtccggttaccccctaccgtaacccgacccgtaccctacggg

SEQ ID NO: 355143 - DNA, 782 bp, Homo sapiens
  misc_feature: GZ8MTXP02G8YFM.21.35.D02.1.454.CMB.2.raw
  modified_base (263)..(263): a, c, t, g, unknown or other
  misc_feature (263)..(263): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgcgctccactgtcaggtccactggtggaggtcgggggagcgtgttccagcctgggacctcctgagagtctccgtgtgcagcctcgtggattcagtcttcaggtcgtactttcgcctagtcgaccgtacgttcgggtcccncctaaggaccctccgaggtacggaaaggggctacggaggtggcgtggacctaaggttactccgagtagttacgaggtaggaagtcggtaatagtacgtactagtcggccgtacgtacggtaggaaacggtacctagtaccaacgtctactacgaagaacgtacctaaacttaaccgaaacaaaccgtccgttcttacgtttccgaagaacctaaagtgaacgacgtaacgacctaaaggaaacggaaacgacgggtaaaccgacgggttaacttaaggttaaactaaccgttaacgtacggtacgggtaaccggtaacgtttaaacgggttaacttttaaacgttaagtttacggtacggtaaacgaaccgggtacttaaacgtacgggtaaaccgttaccgggggaaaccgggggtccgtaaaacccggggttaacccgttcggtaaaccccgttacccgttacccggttacccggaaccctttacccgaccccggtaaccccggtaaaaccccgggg

SEQ ID NO: 355144 - DNA, 663 bp, Homo sapiens
  misc_feature: GZ8MTXP02GMCEL.21.35.D02.1.454.CMB.2.raw
  modified_base (247)..(247): a, c, t, g, unknown or other
  misc_feature (247)..(247): n is a, c, g, or t
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
tcagtcgtcgctcgcacgaccggtgctcgatttagcacacgatagttgggtttgggggaagaggaagactgacggtcctgccacaggtggtgctgggcacggtgggcactcgacacaacatttgtgctccactgtcaggtccacctggtggagtcgggggagcgtgttccagcctgggactccctgagagtctcctgtgcagcctctggattcagcttcagtgactttgcctatgcacgtgggtccnccagctccgaggcaaggggctaggagtggctggctagttancgntattcgagtcggaagcgtaatagtggtactagtcggacggacttccggtaggaaacggggccaattcccgacactacctaccgaaggtaactactaaacttccgaaaaggacctacgtactttcgtttactacgtaataaaacgtcgaaacgtcaaacgacctaaaggaaacgaaggtaacgacgtacggtactaggttaactaactacgtgtacggaccgacggtaacggttaacctttattaagttacgttacggtacgtacggtactagttacgaaccgttacgggaccggggtacgtaccgggtaacccgtcgggtaaccctacccggtcctacccgtacgtacccggtaccctacccgtaaaccggg

SEQ ID NO: 355145 - DNA, 516 bp, Homo sapiens
  misc_feature: GZ8MTXP01BDOHO.21.14.B03.1.454.CMB.2.raw
  modified_base (270)..(270): a, c, t, g, unknown or other
  misc_feature (270)..(270): n is a, c, g, or t
tcagtcgtcgctcgcacgaccggtgctcgatttagtgtgagtagttccgcggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaacncccctaaagctcctgatctatgttgcatccagtttgacaaagtgggtcccccatcaaggttcagtgcaagtggatcgtgggacagatttcactctcacatcagcagtctgacaactgaagtattttggactaaactttactacttgtaccaacagtaacgttacacgtaaccccgtactaacgtttaaggccgaggggaccaaagcgtaggagattacgaaacgacgtgtaggcttagcaacctaa

SEQ ID NO: 355146 - DNA, 572 bp, Homo sapiens
  misc_feature: GZ8MTXP01AIV3Z.21.14.B03.1.454.CMB.2.raw
  modified_base (221)..(221): a, c, t, g, unknown or other
  misc_feature (221)..(221): n is a, c, g, or t
  modified_base (273)..(273): a, c, t, g, unknown or other
  misc_feature (273)..(273): n is a, c, g, or t
tcagtcgtcgctcgcacgaccggtgctcgatttagtgtgagtagttccgcgggggagtcagtctcagtcaggacacagcatggacatgagggtccccgctcagcctcctggggctcctgctactctggctccgaggtgccagatgtgacatccagatgacccagtctccatccctccctgtctgcatctgtaggagacagagtcaccatcacttgccgggnaagtcagagcattagcagctattaaatggtatcagcaagaaaccaggaaacncccctaagcctcctgatctatgttgctatcctagtttgactaaaggtcggggtacccccatcgtaaggttcagtggactggtgatcgtgggacagtatttcactctacacatccagacagtctagaccaacgtagtaagttatttcggacttaaactttactactacgtacaacgtagtacgttaactaccgttaccccgtactacgttaacggaccggaacggggtaacccaaggtccgtaaggacgttacgttaccgaaaacgtacgtggtcggacttacgtaaccgaacgttaacg

SEQ ID NO: 355147 - DNA, 540 bp, Homo sapiens
  misc_feature: GZ8MTXP01DO8IM.21.14.B03.1.454.CMB.2.raw
  modified_base (373)..(373): a, c, t, g, unknown or other
  misc_feature (373)..(373): n is a, c, g, or t
  modified_base (531)..(540): a, c, t, g, unknown or other
  misc_feature (531)..(540): n is a, c, g, or t
tcagtcgtcgctcgcacgaccggtgctcgatttagtgtgagtagtttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccattcaccatctcagaagacaattccaggaacacattgtatcttacaaatgaaataacctgagagccgaggacacggccatgtattactgtgtggggcatttactcgaccccgtggggcccccgggaaccctggtccaccgtccncccccaccctccaccaacgggcccatccggtcctccccctgccaccctcctccaagacgccacctcgtgggggcacgacgcggcccgtgggctcgcccgtggtacaaggacctacgttcccgagcgacgactgaggcggcttggcaaggcgcagttgnnnnnnnnnn

SEQ ID NO: 355148 - DNA, 531 bp, Homo sapiens
  misc_feature: GZ8MTXP01BENJV.21.14.B03.1.454.CMB.2.raw
  modified_base (355)..(355): a, c, t, g, unknown or other
  misc_feature (355)..(355): n is a, c, g, or t
  modified_base (525)..(525): a, c, t, g, unknown or other
  misc_feature (525)..(525): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagctatttaaatggtatcagcagaaaccagggaaacgcccctaagctcctgatctatgttgctatcctagtttgacgtaaaggttcggggtccccccagtactaaaggttcaggtggcnggtggatcgtggggacagtatttcactctcacatcagcagtctgacaactagaagtatttggactaacttactactagtacaacagtaacgttactacgtacccgtactacttaacggccgaggggaccaggcgtaggacgattacaaacgactggtcggcttacgaacnccgtaa

SEQ ID NO: 355149 - DNA, 505 bp, Homo sapiens
  misc_feature: GZ8MTXP01EKHN7.21.14.B03.1.454.CMB.2.raw
  modified_base (202)..(202): a, c, t, g, unknown or other
  misc_feature (202)..(202): n is a, c, g, or t
  modified_base (474)..(474): a, c, t, g, unknown or other
  misc_feature (474)..(474): n is a, c, g, or t
  modified_base (498)..(505): a, c, t, g, unknown or other
  misc_feature (498)..(505): n is a, c, g, or t
tcagtcgtcgctcgcacgaccggtgctcgatttagtgtgagtagtttggtggagactggaggaggcttgatccagcctgggggtccctgagactctcctgtgcagtctctgggttcgtcagtggcgactacatgagctgggtccgccaggctccagggaagggcctggagtggatctcacttatttatagtggtggtaccanatactacacagactccgtgaagggccattcaccatctcagaagacaattccaggaacacattgtatcttcaaatgaaataacctgagagccgaggacacggccatgtattactgtgtggggcatttacttgacccctggggccccgggaaccctggtcaccgtctccccacctccaccagggcccatcggtctcccctgcaccctcctcaagcgcacctctggggcacagcggcctgggctgcctggtcaaggctactccgagcgacactgngcgggcttggcaaggcgcagttgnnnnnnnn

SEQ ID NO: 355150 - DNA, 549 bp, Homo sapiens
  misc_feature: GZ8MTXP01DMPGR.21.14.B03.1.454.CMB.2.raw
  modified_base (273)..(273): a, c, t, g, unknown or other
  misc_feature (273)..(273): n is a, c, g, or t
  modified_base (347)..(347): a, c, t, g, unknown or other
  misc_feature (347)..(347): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctaatttaaatggtatcagacagaaaccaggaaacncccctaagctcctgatctatgtgctatcctagtttgacgaaaggtcgggtaccccatacgaaggttcagtggcngtggatcgagggacagtattcactctacacatcagcagtctgaccaactgaacgttattttacggactaactttactacgtagtaccaacgagtaacgttactacgttaccccgtactacgtttaacgggaccgaggggtaccaaaggcgtagggaacgttattaacgaaaaccggtaactggtggcttcgcaacccgtaag

SEQ ID NO: 355151 - DNA, 579 bp, Homo sapiens
  misc_feature: GZ8MTXP01B1FDD.21.14.B03.1.454.CMB.2.raw
  modified_base (147)..(147): a, c, t, g, unknown or other
  misc_feature (147)..(147): n is a, c, g, or t
  modified_base (204)..(204): a, c, t, g, unknown or other
  misc_feature (204)..(204): n is a, c, g, or t
  modified_base (246)..(246): a, c, t, g, unknown or other
  misc_feature (246)..(246): n is a, c, g, or t
  modified_base (570)..(579): a, c, t, g, unknown or other
  misc_feature (570)..(579): n is a, c, g, or t
tcagtcgtcgctcgcacgaccggtgctcgatttagtgtgagtagtttgggtggagactggaggaggcttgatccagcctggggggtccctgagactctcctgtgcagtctctgggttcgtcagtggcgactacatgagctgggtccnccaggctccgagggaaggcctggagtggatctcacttatttatagtggtggtaccanatactacacagactccgtgaagggccattcacatctcagaanacaattccaggaacacattgtatctacaaatgaaataacctgagagccgagacacggcatgtattactgtggtgggctagtttacgtcgaccccgtgggggacccccggaacctggtccacccgtcctaccccaccctccaccgacgggcccactccggtccttcccccgtcgcctacccctcctaccaagacgccacccgtcggtcggggaccacgacgccggcccgtgggccgtcgccgttcggtaccgaaacggtcccttaaccgttcccggaaagtccggacgacgtggacggtcgggcttgggacaaggcgacagttgnnnnnnnnnn

SEQ ID NO: 355152 - DNA, 525 bp, Homo sapiens
  misc_feature: GZ8MTXP01CN5TV.21.14.B03.1.454.CMB.2.raw
  modified_base (517)..(525): a, c, t, g, unknown or other
  misc_feature (517)..(525): n is a, c, g, or t
tcagtcgtcgctcgcacgaccggtgctcgatttagtgtgagtagtttgggtggagactggaggaggcttgatccagcctgggggtccctgagactctcctgtgcagtctctgggttcgtcagtggcgactacatgagctgggtccgccaggctccagggaagggcctggagtggatctcactttatttatagtggtggtaccacatactacacagactccgtgaagggccattcaccatctcagaagacaattccaggaacacattgtatcttacaaatgaaataacctgagagccgagacacggccatgtatactgtgtgggcatttactgaccctggggccccggggaacctggcaccgtcctaccccaccctccaccaagggcccactcggtctccccctgccaccctcctcaagcgcacctctggggcacagccggccctggggctcgccgtgtcgaaaggtctaaccgttccgaagcgaacgacctgagcgggcttggcaaggcgcagttgnnnnnnnnn

SEQ ID NO: 355153 - DNA, 562 bp, Homo sapiens
  misc_feature: GZ8MTXP01C8TGY.21.14.B03.1.454.CMB.2.raw
  modified_base (278)..(278): a, c, t, g, unknown or other
  misc_feature (278)..(278): n is a, c, g, or t
  modified_base (392)..(392): a, c, t, g, unknown or other
  misc_feature (392)..(392): n is a, c, g, or t
  modified_base (514)..(514): a, c, t, g, unknown or other
  misc_feature (514)..(514): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttggaccgggaaatcagagcattagcagtacttatttaaattggtatcagcaagaaaccagggaaacncccctaagctcctgatctatgtgcattccagtttgactaaaggtgggtaccctagtactaaggttcaggtggactaaggtggatcgtagggacagtattcactctacacatcancagtctagacaactagtaagttatttacgacttaaacttacttactacgtacaaacgtagtaacgttaacctacgttaaccccgtactaccgtttaacggccgtaagggacaagcgtagganaacgttacaaaacgtaacgtggtaacggctcgacctaacttaagttcg

SEQ ID NO: 355154 - DNA, 544 bp, Homo sapiens
  misc_feature: GZ8MTXP01CDVC3.21.14.B03.1.454.CMB.2.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
  modified_base (278)..(278): a, c, t, g, unknown or other
  misc_feature (278)..(278): n is a, c, g, or t
  modified_base (418)..(418): a, c, t, g, unknown or other
  misc_feature (418)..(418): n is a, c, g, or t
tcagtcgtcgctcgcacgaccggtgctcgatttagtgtgagtagttccgcgggggagtcagtctcagtcaggacacagcatggacatggacgggtccccgctcagctccgtggggctcctgctactctggctccgaggtgccagatgtgacatccagatgacccagtctccatccctcctgtctgcatctgtagganacagagtcaccatcacttggccgggnaagtcagagctattagcagtctatttaaatggtatcagcaagaaaccagggaacncccctaagctcctgactctatgttgcatcctagtttcgactaaaggtcggggtacccccagtagtaaggttcaggtggacaaggtggatcgtaggggacagtatttcacttctacactatcagcagtcagcaactgaatntttcgactaacttactactgtacaacagtaagttacctacgtaccccgtatactttaacggccgttaggggaaccaggccgtggaacgttattaaccgaacgacgtggtcggcttcgccaacttcg

SEQ ID NO: 355155 - DNA, 654 bp, Homo sapiens
  misc_feature: GZ8MTXP01CAZJH.21.14.B03.1.454.CMB.2.raw
  modified_base (193)..(193): a, c, t, g, unknown or other
  misc_feature (193)..(193): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctcctgtctgcatctgtagganacagagtcaccatcacttgccggcaagtcagagcattagcagactaatttaaatggtatcagacaagaaaccgaggaaacgacccctaaagcctacctgatctatgttgctatcctagtttagacgtaaaggtcggggtacccccctagtacgtaaagggtttccaaggttcgggacgtaaggtgggtaagttccgtagggggaacctaggtactttactacctctaccacctatcaggacctacggtctcggacctaaaccgtgtaaagttattttacgggaccttaaaactttacctaactagttaaccaaacgtaacgtaacgttaacctaccggttaacccccgttaacgtaaccgtttaacgggaccgttaacgggggaaccaacggtaccgtagggaacgttagttaaccgaaaacgtacgttcggtacgggcttacggaaccaaccgttaaccg

SEQ ID NO: 355156 - DNA, 552 bp, Homo sapiens
  misc_feature: GZ8MTXP01EX00Z.21.14.B03.1.454.CMB.2.raw
  modified_base (194)..(194): a, c, t, g, unknown or other
  misc_feature (194)..(194): n is a, c, g, or t
  modified_base (281)..(281): a, c, t, g, unknown or other
  misc_feature (281)..(281): n is a, c, g, or t
  modified_base (306)..(306): a, c, t, g, unknown or other
  misc_feature (306)..(306): n is a, c, g, or t
  modified_base (414)..(414): a, c, t, g, unknown or other
  misc_feature (414)..(414): n is a, c, g, or t
  modified_base (433)..(433): a, c, t, g, unknown or other
  misc_feature (433)..(433): n is a, c, g, or t
  modified_base (552)..(552): a, c, t, g, unknown or other
  misc_feature (552)..(552): n is a, c, g, or t
tcagtcgtcgctcgcacgaccggtgctcgatttagtgtgagtagtcccgcgggggagtcagtctcagtcaggacacagcatggacatgagggtccccgctcagctcctggggctcctgctactctggctccgaggtgccagatgtgacatccagatgacccagtctccatccctcctgtctgcatctgtagganacagagtccaccatcacttggccgggcaagtcagagctatagcagtcttaatttaaagtggtatcagacaagaaaccgagggaaacncccctaagcctactgatctatgttnctatcctagtttgacgtaaaggtcggtacccccatacgtaaggttcaggtggacaaggtggaatcgtagggactagtactttacacttcaccaccatcagacagttcncgactaacctggtaaattnttttacgacttaaacttactacgtcgtacaacgtagtacgtaacctacgtaccccgtataacgttcggacgagggaccagcgtagacgttattacaaagactgtagcttagcttaactn

SEQ ID NO: 355157 - DNA, 581 bp, Homo sapiens
  misc_feature: GZ8MTXP01ARGN0.21.14.B03.1.454.CMB.2.raw
  modified_base (274)..(274): a, c, t, g, unknown or other
  misc_feature (274)..(274): n is a, c, g, or t
tcagtcgtcgctcgcacgaccggtgctcgatttagtgtgagtagttccgcgggggagtcggtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccggcaagtcagagcattagcagcttaatttaaatggatcagcaagaaaccgagggaaacncccctaagctcctgatctatgttgcatctagtttgactaaaggtcgggtcccataccgtaaaggttcaggtgactagtggatcgtgggactagtactttcactctacaccatcagctaacgtctagacaaccgttgtaacgtatttcgaacttaactttaactactcgtaacaaacgtacgtaacgtttaccacgttaacccccgttaagtaaccgtttaacgggaacccggtaaggggttacccaaagccgtaagggacgaattacgaaacgtaatcggtggacctgacctaaccttaagttcccg

SEQ ID NO: 355158 - DNA, 567 bp, Homo sapiens
  misc_feature: GZ8MTXP01DCMEN.21.14.B03.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (268)..(268): a, c, t, g, unknown or other
  misc_feature (268)..(268): n is a, c, g, or t
tcagtcgtcgctcgcacgaccggtgctcgatttagtgtgagtagtcccgcgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagctattaaatgtatcagcagaaaccaggaaancccctaagctctgatctatgttgctatcctagtttgacgaaaggtcggggtacccccaagttacgaagggtttcaggttagggactaaggtgggaattccgtaggggaacctaggtatttcactctacaccatcagcagtctagcaaccgtgaagtatttacgactaactttaactactgtacaaactagtaagttactacgtaacccgtactacgtttaacggccgttaagggggaccaaggacgtggaaagcttaacgaaacggtaactggtacgcgttacggtaaccaacctaacg

SEQ ID NO: 355159 - DNA, 632 bp, Homo sapiens
  misc_feature: GZ8MTXP01A1ENH.21.14.B03.1.454.CMB.2.raw
  modified_base (218)..(218): a, c, t, g, unknown or other
  misc_feature (218)..(218): n is a, c, g, or t
  modified_base (271)..(271): a, c, t, g, unknown or other
  misc_feature (271)..(271): n is a, c, g, or t
  modified_base (344)..(344): a, c, t, g, unknown or other
  misc_feature (344)..(344): n is a, c, g, or t
  modified_base (384)..(384): a, c, t, g, unknown or other
  misc_feature (384)..(384): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaccatcacttgccgggnaagtcagagcattagcagctatttaaatggtatcagcagaaaccagggaaacncccctaaagctcctgatctatgttgcatcctagtttgactaaaggtcggggcccccatcaaaggttcagtgcngtggatctgggactagtactttcacttcacaccatccganactagtctcgactaacgtagtaacgttactttacggacttaacttactaacgttagtaacctaaacgtaacgttaaacgttaacccgtaaccgtttaaaccccgtaacgtttaaccggttaaccgggaaccgggttaaacgggggtaaaccttaacggtaccgttaacgggaaacgttaaccgttaaaccgaaaaccggttacgttaacgggtacggtaccgttaccggtaacccgttaaccgtaacg

SEQ ID NO: 355160 - DNA, 581 bp, Homo sapiens
  misc_feature: GZ8MTXP01B2INF.21.14.B03.1.454.CMB.2.raw
  modified_base (284)..(284): a, c, t, g, unknown or other
  misc_feature (284)..(284): n is a, c, g, or t
  modified_base (309)..(309): a, c, t, g, unknown or other
  misc_feature (309)..(309): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttggccgggacaagtcagagctattagcagtacttaatttaaatggtaatcagacaagaaaccgagggaaacncccctaagcctactgatctatgttnctatcgtagttgacgtaaggtcggtaccccagtacgtaaggtcaggtgacgtaaggtggtattcggtagggactagttactttccacttctaccaaccgtataccgaagacctaagttcctacggacctaaccgtagtaaacgttacttttacggaactttaaacgttactacgtagtaacaaacgtagtaacgttactaccgtaacccgtatacggtaacgcgaggacagcgtagagttacgacgaatacgtgcgcttacgtccaagtaac

SEQ ID NO: 355161 - DNA, 593 bp, Homo sapiens
  misc_feature: GZ8MTXP01D7AKH.21.14.B03.1.454.CMB.2.raw
  modified_base (196)..(196): a, c, t, g, unknown or other
  misc_feature (196)..(196): n is a, c, g, or t
  modified_base (220)..(220): a, c, t, g, unknown or other
  misc_feature (220)..(220): n is a, c, g, or t
  modified_base (281)..(281): a, c, t, g, unknown or other
  misc_feature (281)..(281): n is a, c, g, or t
  modified_base (441)..(441): a, c, t, g, unknown or other
  misc_feature (441)..(441): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtcctccatccctccctgtctgcatctgtagganacagatcacatcacttggccgganaagtcagagctatagcagtacttaatttaaatggtatacagacaagaaaccgagggaaacncccctaaagcctctagatctatgttagactatctagtttgacgtaaaggtcggtacccccatacgtaaggttcaggtacgataaggtgactcggtagggactagttactttcactctacaaccatacagtactagtactacgactaaacgtgtaaagttntttacgaacttaactttacctacgtactaacgaaactagtaaacgtactaaccgtaccccgtactaacggttaacggacggaagggaaccaagtcggtaggaacgttacaacgtaaaacggtcttggtacggcttacgaaccttaactaacg

SEQ ID NO: 355162 - DNA, 649 bp, Homo sapiens
  misc_feature: GZ8MTXP01CTQH2.21.14.B03.1.454.CMB.2.raw
  modified_base (235)..(235): a, c, t, g, unknown or other
  misc_feature (235)..(235): n is a, c, g, or t
  modified_base (386)..(386): a, c, t, g, unknown or other
  misc_feature (386)..(386): n is a, c, g, or t
  modified_base (437)..(437): a, c, t, g, unknown or other
  misc_feature (437)..(437): n is a, c, g, or t
  modified_base (649)..(649): a, c, t, g, unknown or other
  misc_feature (649)..(649): n is a, c, g, or t
tcagtcgtcgctcgcacgaccggtgctcgatttagtgtgagtagttccgcggggggagtcagtctcagtcaggacacagcatggacatgagggtccccgctcagctcctggggctcctgctactctggctccgaggtgccagatgtgacatccagatcgaccctagtcctccactccctcctgtctgcatctgtaggagacagacgtcacatcacttcggccggacaagtcaganactattagcagtacttaatttaagtgtatcgaagacgaacgaaacgagggaaactcccctaaagccttactagatctatcgttagactatccgtaggtttcgaacggtaaacggttccggtaccccctagtacggtaggtcgaggtacggngtaaggtgtacctgggtacggatacggttactttacacttccactaaccgntacgagtactacgtctacgtactaacgtagttaattcgttaacgtaaccttaactttacacgttacgaacgtaacgtaacgttacccgttaccgtaaccccggtaaccgttacgtaaccggtaacggaaccggaacgggaaccaggttaacgacggaaacgttaccgttaaaccgtaacgtcgtcggtcgtaccgttactaacccgttcgtn

SEQ ID NO: 355163 - DNA, 599 bp, Homo sapiens
  misc_feature: GZ8MTXP01DUNIM.21.14.B03.1.454.CMB.2.raw
  modified_base (195)..(195): a, c, t, g, unknown or other
  misc_feature (195)..(195): n is a, c, g, or t
  modified_base (222)..(222): a, c, t, g, unknown or other
  misc_feature (222)..(222): n is a, c, g, or t
  modified_base (278)..(278): a, c, t, g, unknown or other
  misc_feature (278)..(278): n is a, c, g, or t
  modified_base (292)..(292): a, c, t, g, unknown or other
  misc_feature (292)..(292): n is a, c, g, or t
  modified_base (593)..(593): a, c, t, g, unknown or other
  misc_feature (593)..(593): n is a, c, g, or t
tcagtcgtcgctcgcacgaccggtgctcgatttagtgtgagtagtcccgcgggggagtcagtctcagtcaggacacagcatggacatgagggtccccgctcagctcctggggctcctgctactctggctccgaggtgccagatgtgacatccagatgacccagtctccatccctccctgtctgcatctgtagganacagagtcaccatcacgttgccggganaagtcagagctatagcagacttaattaaatggatcgagacaagaaaccgaggaacncccctaaagcctcngatctagtgtgcaatccgtagtttcgacgtaaaggtcggtaccccccaatacgtaaggttcaggtcgggactaagggtgtaaatccggtagggaactagtaatttccacgttctaaccaacctataccgaaggtactacgtcctacgaacctaaccgtaggtaaacgttacgtttacggaaccttaaacgtttaccacgttagaccaaacgtagtaacgttacaaccgtaccctatacgttaaggaccacggggtaacagtcgtaggaacacgttacaaacgtactggtcgcttacgaacnccgtaa

SEQ ID NO: 355164 - DNA, 498 bp, Homo sapiens
  misc_feature: GZ8MTXP02JUEHO.21.14.B03.1.454.CMB.2.raw
  modified_base (272)..(272): a, c, t, g, unknown or other
  misc_feature (272)..(272): n is a, c, g, or t
  modified_base (342)..(342): a, c, t, g, unknown or other
  misc_feature (342)..(342): n is a, c, g, or t
  modified_base (445)..(445): a, c, t, g, unknown or other
  misc_feature (445)..(445): n is a, c, g, or t
  modified_base (498)..(498): a, c, t, g, unknown or other
  misc_feature (498)..(498): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaattggtatcagcagaaaccagggaaacncccctaagctcctgatctatgttgcatccagtttgacaaaggtggggtcccccatcaaggttcagtggcngtggatcgtggacagtatttcactctcaccatcagcagtctgacacctgaagtattttgactaacttactactagtacaacagtagttacacgttacccgtanacgtttacggccgagggaccaagctagacgatacaaacgactgtagctgcacn

SEQ ID NO: 355165 - DNA, 482 bp, Homo sapiens
  misc_feature: GZ8MTXP02JMOZV.21.14.B03.1.454.CMB.2.raw
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
  modified_base (475)..(475): a, c, t, g, unknown or other
  misc_feature (475)..(475): n is a, c, g, or t
tcagtcgtcgctcgcacgaccggtgctcgatttagtgtgagtagttccgcggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccaggaaagcccctaagctcctgatctatgttgcatccagtttgcaaagtgggtcccccatcaaggttcagtggcagtggatctgggacagatttcactctcaccatcagcagtctgcaacctgaaagattttgctaacttactactgtcaaacagagttacagtacccgtacactttaggccaggggaccaagcngaganacaacgaacagtgcncgcacac

SEQ ID NO: 355166 - DNA, 563 bp, Homo sapiens
  misc_feature: GZ8MTXP02JFPPX.21.14.B03.1.454.CMB.2.raw
  modified_base (553)..(554): a, c, t, g, unknown or other
  misc_feature (553)..(554): n is a, c, g, or t
  modified_base (556)..(563): a, c, t, g, unknown or other
  misc_feature (556)..(563): n is a, c, g, or t
tcagtcgtcgctcgcacgaccggtgctcgatttagtgtgagtagtttggtggagactggaggaggcttgatccagcctgggggtccctgagactctcctgtgcagtctctgggttcgtcagtggcgactacatgagctgggtccgccaggctccagggaagggcctggagtggatctcacttatttatagtggtggtaccacatactacacagactccgtgaagggccattcaccatctcagaagacaattccaggaacacattgtatcttcaaatgaataacctgagagccgagacacggccatgtattactgtgtggggcatttactgacccctggggccccggggaacctggtcaccgtctccccacctccaccaacggcccatcggtccttccccctgggcccacccgtccctcccaacgacgccaccctcgtcgggggccacgacgccgggccccgtggggccttcggcccgttgggtccgaaacgggacctaaccgttccccggagccgaccgaactgagccggggctgggcaaggcggcacgtagnngnnnnnnnn

SEQ ID NO: 355167 - DNA, 515 bp, Homo sapiens
  misc_feature: GZ8MTXP02JBOQ9.21.14.B03.1.454.CMB.2.raw
  modified_base (269)..(269): a, c, t, g, unknown or other
  misc_feature (269)..(269): n is a, c, g, or t
  modified_base (395)..(395): a, c, t, g, unknown or other
  misc_feature (395)..(395): n is a, c, g, or t
  modified_base (482)..(482): a, c, t, g, unknown or other
  misc_feature (482)..(482): n is a, c, g, or t
tcagtcgtcgctcgcacgaccggtgctcgatttagtgtgagtagttccgcggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaancccctaagctcctgatctatgttgcatccagtttgactaaagtcggggtcccccatcaaggttcagtggcagtgatcgtgggacagtatttcactctcaccatcagcagtctgcaactgaaacgtnttttagacttaacttactactgtacaacagtagttacacgtacccgtactacgtttacggaccgaggggaccaaagcgtacgggaanagtacgaaacgtaactcgtacggctgaccacta

SEQ ID NO: 355168 - DNA, 545 bp, Homo sapiens
  misc_feature: GZ8MTXP02IF17C.21.14.B03.1.454.CMB.2.raw
tcagtcgtcgctcgcacgaccggtgctcgatttagtgtgagtagtcccgcgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaagcccctaagctcctgatctatgttgcatccagtttgcaaagtgggtccccatcaggttcagtgcagtgatcgtggactgatttcactctcacatcagcagtctgcactgaagtattttgactaacttactacttagtacaaacgagtacgttacaacgtaccccgtaactaacgttttacggaccgtaacgggggaacctaaaggaccttacgggaagtaacgtaccgaaaaacggtaaccgtaggttacggaaccgttcggacctaaccctaacg

SEQ ID NO: 355169 - DNA, 546 bp, Homo sapiens
  misc_feature: GZ8MTXP02IGCCD.21.14.B03.1.454.CMB.2.raw
  modified_base (385)..(385): a, c, t, g, unknown or other
  misc_feature (385)..(385): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagtctaatttaaattggtatcagcaagaaaccaggaaacgcccctaaagctcctgatctatgttgcatcagtttgactaaaggtcgggtccccatactaaggttcagtggcaggtgaatcgtagggacagtatttcactctcacatcagnagtctgacaactaggaatattttacacttaaacttactactagtaccaataagtacgttacaacgtaccccgtagtaactttacggacgaacggggacctaaaggcgttaggaacgtactaacgaaaacgtaaacgtcgtacggacttcggactacctaag

SEQ ID NO: 355170 - DNA, 559 bp, Homo sapiens
  misc_feature: GZ8MTXP02JO6KI.21.14.B03.1.454.CMB.2.raw
  modified_base (397)..(397): a, c, t, g, unknown or other
  misc_feature (397)..(397): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaacgcccctaagctcctgatctatgttgcatcctagtttgcaaaggtgggtacccccatcaaggttcagtggcaggtggatcgtgggacagtattcactctcacatcagcagtctgacaacctgaaagtnttttagactaacttactacttagtacaaacgtagtaacgttaacctacgttaaccccgtaactaccgtttacggacccgtaaggggaccaaacggtccgttacgggaagtaactaccgaaaacgtaaccgttaggtacgggacctacggacctaccctaacg

SEQ ID NO: 355171 - DNA, 572 bp, Homo sapiens
  misc_feature: GZ8MTXP02IG8H4.21.14.B03.1.454.CMB.2.raw
  modified_base (194)..(194): a, c, t, g, unknown or other
  misc_feature (194)..(194): n is a, c, g, or t
  modified_base (277)..(277): a, c, t, g, unknown or other
  misc_feature (277)..(277): n is a, c, g, or t
tcagtcgtcgctcgcacgaccggtgctcgatttagtgtgagtagtcccgcgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggcaagtcagagcattagcagcttaatttaaattggtatcatacaagaaaccagggaaacncccctaagctcctgatctatgttgctatcctagtttgacgtaaaggtcggggtcccccagtacgaaaggttcaggtggctaggtggatcgtagggacagtatttcactcacacatacagctagtctgacactgaagttatttacgactaactttactactagtaccaaacgtagtacgttaaccgtacgttaaccccgtaacgttaccgtttaacggacccgtaacgggggaacctaaacggtacgtacggaaagtactaacgaaaacgtacgtaggtcggactcgaccactacg

SEQ ID NO: 355172 - DNA, 491 bp, Homo sapiens
  misc_feature: GZ8MTXP02FO419.21.14.B03.1.454.CMB.2.raw
  modified_base (269)..(269): a, c, t, g, unknown or other
  misc_feature (269)..(269): n is a, c, g, or t
  modified_base (335)..(335): a, c, t, g, unknown or other
  misc_feature (335)..(335): n is a, c, g, or t
  modified_base (431)..(431): a, c, t, g, unknown or other
  misc_feature (431)..(431): n is a, c, g, or t
tcagtcgtcgctcgcacgaccggtgctcgatttagtgtgagtagtcccgcggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatggtatcagcagaaaccagggaaancccctaagctcctgatctatgttgcatccagtttgcaaagtgggtccccatcaaggttcagtggcngtgatcgtgggacagatttcactctcaccatcagcagtctgcaactgaaagtatttgactaacttactactgtacaacagagttacagtaccctanacgtttaggccgaggggacaaagctaggacatacgaaacgtactgtacggctgacactac

SEQ ID NO: 355173 - DNA, 522 bp, Homo sapiens
  misc_feature: GZ8MTXP02GRPZU.21.14.B03.1.454.CMB.2.raw
  modified_base (271)..(271): a, c, t, g, unknown or other
  misc_feature (271)..(271): n is a, c, g, or t
  modified_base (339)..(339): a, c, t, g, unknown or other
  misc_feature (339)..(339): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaatggtatcagcagaaaccagggaaancccctaagctcctgatctatgttgcatccagtttgcaaagtggggtcccccatcaaggttcagtggcngtggatcgtgggacagtatttcactctcaccatcagcagtctgcaacctgaagtattttgactaaacttactactgtaccaaacagaacgtttaacacgtaaccccgtactacgtttaacggcccgaagggggacccaaagcgtaggacgatacgaaaacgtaactagtcggctacgcaccta

SEQ ID NO: 355174 - DNA, 520 bp, Homo sapiens
  misc_feature: GZ8MTXP02GSWUO.21.14.B03.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (339)..(339): a, c, t, g, unknown or other
  misc_feature (339)..(339): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagcattagcagctatttaaatgtatcagcagaaacaggaagcccctaagctcctgatctatgttgcatccagtttgacaaagtggggtacccccagtctaaggttcagtggcnggtgatcgtgggacagatttcactctcacatcagcagtctgcaacctgaaagtattttacgactaactttactacttagtactaaacagtaagttaaccagttaccccgtactaacgtttacgaccgaggggtaaccaaggctaggagaactacgaaacgactaggtcgctacgacactag

SEQ ID NO: 355175 - DNA, 522 bp, Homo sapiens
  misc_feature: GZ8MTXP02FX4P2.21.14.B03.1.454.CMB.2.raw
  modified_base (430)..(430): a, c, t, g, unknown or other
  misc_feature (430)..(430): n is a, c, g, or t
  modified_base (500)..(500): a, c, t, g, unknown or other
  misc_feature (500)..(500): n is a, c, g, or t
  modified_base (515)..(522): a, c, t, g, unknown or other
  misc_feature (515)..(522): n is a, c, g, or t
tcagtcgtcgctcgcacgaccggtgctcgatttagtgtgagtagtttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccattcaccatctcagaagacaattccaggaacacattgtatcttcaaatgaataacctgagagccgaggacacggccatgtattactgtgtggggcatttacttgacccccgtggggccccggggaacccctggtcaccggtctcccccaccctccaccaaagggcccatccgtcttccccctggccaccctccctccaagncacctctgggggcacagcggccctgggctgcctggtcaaggctacttcccgagcgacgactgagcgggcnggcaaggcgcatagnnnnnnnn

SEQ ID NO: 355176 - DNA, 552 bp, Homo sapiens
  misc_feature: GZ8MTXP02H3JQP.21.14.B03.1.454.CMB.2.raw
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
  modified_base (338)..(338): a, c, t, g, unknown or other
  misc_feature (338)..(338): n is a, c, g, or t
  modified_base (347)..(347): a, c, t, g, unknown or other
  misc_feature (347)..(347): n is a, c, g, or t
tcagtcgtcgctcgcacgaccggtgctcgatttagtgtgagtagtcccgcgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctattaaatgtatcagcagaaaccagggaaacncccctaagctctgatctatgttncatccagtttgacaaaggtcgggtaccccatcaaggtcagtggcnggtgatcgnggacagtatttcactcacacatcagcagtctgacactgaagtattttagacttaacttactactagtacaactagtaacgtactaaccgttacccgtactaacgtttacggaccgtaacgggggaacctaacggtacgtagggaactaacgttaaccgaaaacggtaacgttcgggttacggaccgtacggtaccaaccgtaacg

SEQ ID NO: 355177 - DNA, 573 bp, Homo sapiens
  misc_feature: GZ8MTXP02HKKS9.21.14.B03.1.454.CMB.2.raw
  modified_base (272)..(272): a, c, t, g, unknown or other
  misc_feature (272)..(272): n is a, c, g, or t
  modified_base (349)..(349): a, c, t, g, unknown or other
  misc_feature (349)..(349): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggacaagtcagagcattagcagctattaaattgtatcagcaagaaaccaggaaacncccctaagctacctgatctatgtgctatcctagttgactaaaggtcgggtaccccctatacgtaaggttcagtggcnggtgatcgtggatagtattcactctacacatcagactagtctcgactaacctagtaaagtacttttcgaacttaacttactacttacgtaccaaagtacgtaacgttaaccgtaaccgttaaccccggtactaaccgtttaacgggaccgaaaggggaacgtaacggacgtacggaagtacgtaaccgtaaacgtacgtagtcggtactacggacctaactacg

SEQ ID NO: 355178 - DNA, 609 bp, Homo sapiens
  misc_feature: GZ8MTXP02HN5LJ.21.14.B03.1.454.CMB.2.raw
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
tcagtcgtcgctcgcacgaccggtgctcgatttagtgtgagtagtcccgcgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagtctaatttaaattggtatcagacaagaaaccgagggaaacacccctaagctcctagatctatgttgctactcctagtttagacgtaaaggtcggggtaccccagtacgtaaggttcaggttggcaggtgatcgtggacagtattcactctcacatcancgacgtcncgactaactagtaaagttattttacgacttaacttactacttagtaacaacgtagtacgttaacctaaccggttaaccccgtaacgttaaccgtttaacgggacccggaaacggggtaaacccgaaggtacgttacgggaactaacgttaaaccgaaaaccggtaaaccggttaggtacggaccttacggaccctaacgttaaccg

SEQ ID NO: 355179 - DNA, 597 bp, Homo sapiens
  misc_feature: GZ8MTXP02J0IC0.21.14.B03.1.454.CMB.2.raw
  modified_base (278)..(278): a, c, t, g, unknown or other
  misc_feature (278)..(278): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcattagcagcttaatttaaattggtatcagacaagaaaccagggaaacncccctaagcctcctgatctatgttgctatcctagtttgactaaaggtcgggtaccccagtcgtaaggttcaggtggcaggtgatcgtgggacagtacttcactctacaccatccagcagtcctagacctaaaccgtgtaaagttattttcgactaactttactacgttagtaccaaacgtacggtaacgttaccaaccggttaacccccgtaacgttaaccgtttaaccgggacccgtaaacgggggaaccctaaaggtaccgtaggaaacgtaactaaccgaaaaccgtacgtaggtacggactcggtaccaactacg

SEQ ID NO: 355180 - DNA, 600 bp, Homo sapiens
  misc_feature: GZ8MTXP02ILXA8.21.14.B03.1.454.CMB.2.raw
  modified_base (316)..(316): a, c, t, g, unknown or other
  misc_feature (316)..(316): n is a, c, g, or t
  modified_base (371)..(371): a, c, t, g, unknown or other
  misc_feature (371)..(371): n is a, c, g, or t
  modified_base (588)..(589): a, c, t, g, unknown or other
  misc_feature (588)..(589): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (595)..(596): a, c, t, g, unknown or other
  misc_feature (595)..(596): n is a, c, g, or t
  modified_base (598)..(600): a, c, t, g, unknown or other
  misc_feature (598)..(600): n is a, c, g, or t
tcagtcgtcgctcgcacgaccggtgctcgatttagtgtgagtagtttgggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccattcaccatctcagaagacaattccaggaacacattgtatcttacaaatgaaataacctgagagcgagacacggccatgtattacngtgtgggctatttactcgaccccgtggggaccccgggaacctcggtcaccgtccncccccaccctccaccgaacggcccacgtccgtcctccccctggccctacccctcctacccaagacgcccacctcggtcggggccaccgacgcccggccccgtgggccctcggtcccgtagggtaccgaaacgggaccctttacccgttccccggaacgccggtaaccgaccgtaggaacggtccggggctcggggaccaaacgggccgacgacgagnngncncnncnnn

SEQ ID NO: 355181 - DNA, 579 bp, Homo sapiens
  misc_feature: GZ8MTXP02FSOA1.21.14.B03.1.454.CMB.2.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcacatcacttgccgganaagtcagagcattagcagtacttaatttaaagtggtatacgaagacaaagaaaaccgaagggaaacgccccctaaagcctccgtagactctatgttagactatccgtagtttgacgtaaaggtcgggtaccccatcgtaaggtcaggtggactaggtgatcgtagggactagtacttcactctacacatcaagcacgttcacgacctaaaccgtgtaaacgttatttacgaacttaacttactactagtaacaacgtagtacgttaacaccgttaacccgtatacgttacggaccgaagggacctaaggcgtaggaactaacgtaacgaaaacgtacttggacgtcacggacctacttacg

SEQ ID NO: 355182 - DNA, 712 bp, Homo sapiens
  misc_feature: GZ8MTXP02HC3SF.21.14.B03.1.454.CMB.2.raw
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctccctgtctgcatctgtagagacagatcaccatcacttgccgggcaagtcagagctagttagcagtacttaatttaaagttggtatcgagaccaaagaaaaccgaagggaaacacccccgtaagcctcctagacttctagtgttcgctatccgtagtttcgacgtaaaggtcgggtaccccctagtacgtaaggttcaggtggacgtaggtggtaacttcggtaggggtaaacctaggttactttaccctaacttaccctacccgtaacctaactccgaaacgtacgtacggtacctaccgtacctaaaccgtagtaaagttacgtttttacgaaccctttaaaaccgtttaaccttaccgttaacggtaaccctaaacgtaaacgtaaaccggtttaacctaacccggttaacccccgtttaaacgtaacccggttttaacggacccggtaaacgggggaccctaaaacgggtcggtacggaaacgtacgttaaacgaaaaccgtaacgtcggtacggtcctacggtacctaacctacg

SEQ ID NO: 355183 - DNA, 590 bp, Homo sapiens
  misc_feature: GZ8MTXP02JB26E.21.14.B03.1.454.CMB.2.raw
  modified_base (413)..(413): a, c, t, g, unknown or other
  misc_feature (413)..(413): n is a, c, g, or t
  modified_base (580)..(581): a, c, t, g, unknown or other
  misc_feature (580)..(581): n is a, c, g, or t
  modified_base (583)..(584): a, c, t, g, unknown or other
  misc_feature (583)..(584): n is a, c, g, or t
  modified_base (586)..(590): a, c, t, g, unknown or other
  misc_feature (586)..(590): n is a, c, g, or t
tcagtcgtcgctcgcacgaccggtgctcgatttagtgtgagtagtttggtggagactggaggaggcttgatccagcctggggggtccctgagactctcctgtgcagtctctgggttcgtcagtggcgactacatgagctgggtccgccaggctccagggaagggcctggagtggatctcacttatttatagtggtggtaccacatactacacagactccgtgaagggccattcaccatctcagaagacaattccaggaacacattgtatcttacaaatgaataacctgagagccgagacacggccatgtattactgtgtggggctatttacgtgaccccgtggggaccccggggaacccgtggtcaccgtctacccccaccctccaccaacggcccatccggtccttcccccnggccacccgtcctccaacgacgcacctccgtgggggaccacgacgccggtcccgtcggggcttcggcccgttgggtaccgaaacggacccgttaacgttaccccggacggaccggacggaacgtcgaacgggccgggcgtgggccggaaagggccgaccgaagtagnngnncnnnnn

SEQ ID NO: 355184 - DNA, 658 bp, Homo sapiens
  misc_feature: GZ8MTXP02H8UDK.21.14.B03.1.454.CMB.2.raw
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctcctgtctgcatctgtaggagacagagtcaacatcacttggccgggacaagtcagagctattagcagtcttaattaaagtggtatcaagacaagaaaaccgaagggaaaccgtcccctaaaggccttacccgtagaacttactaagttcgttacgactaacttcctaaggtttacgaaccgtaaaagggttccggggtaacccccctaagttaccgtaaacgggttacagggttacgggactaggggtgtaacgtaccgtaggggaactaggtactttcacctctacactactacgagactagtctacgactactagaagttattagtactaaacttactacgtactaacaaacgtagtaacgttaacgaaccgttacccgttaaacgtaaccgtttacggaaccggtaacgggggaaactaaacggcgttaggaacgtaactaacgaaaacgtaacgtcggtacggactacggaccaaccgtacg

SEQ ID NO: 355185 - DNA, 574 bp, Homo sapiens
  misc_feature: GZ8MTXP02JZ6U8.21.14.B03.1.454.CMB.2.raw
  modified_base (277)..(277): a, c, t, g, unknown or other
  misc_feature (277)..(277): n is a, c, g, or t
tcagtcgtcgctcgcacgaccggtgctcgatttagtgtgagtagtcccgcgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagtcttatttaaattggtatcagcaagaaaccgagggaaacncccctaagctacctgatctatgttgctatcctagtttgacgtaaaggtcggggtacccccagtacgtaaggttcaggtggctaggtggatcgtagggactagtactttcaccttctacacatcagcagtctcgacaacgtagaagtatttcgactaacttactactagtacaaacgtagtacgttaacgaccgttaccccgtaacgtaccgtttacgggaccgtaacgggggaacccaaggtcgtaggaactacgtaaccgaaacgtacgtaggtacggacgtacggacctactacg

SEQ ID NO: 355186 - DNA, 652 bp, Homo sapiens
  misc_feature: GZ8MTXP02HP6CA.21.14.B03.1.454.CMB.2.raw
  modified_base (296)..(296): a, c, t, g, unknown or other
  misc_feature (296)..(296): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagagtcaccatcacttgccgggcaagtcagagcatagcagctattaaatgtatcagcaagaaaccagggaaacgcccctaagcctcctgatctatgttnctatcctagtttgacgtaaaggtcggggtacccccagttaccgtaaaggtttcgaggttcggactagggtggattcgtagggggaacctaggtattttccacttctaccaacctatacgagtactaggttcctacgaacctaaaccgtagtaaaagtttatttttacgacctttaaactttacttaacttacgttaaccaaaccgtaagtaacgttaaccgtaaccgttaacccccgtaacttaaccggtttaacggacccggtaacgggggaaccaacggtaccgttacggggaacgtaacgtaaaccgaaaaccggtaacgttacgggttacggcgttacgacctaacctaacg

SEQ ID NO: 355187 - DNA, 720 bp, Homo sapiens
  misc_feature: GZ8MTXP02IZUU6.21.14.B03.1.454.CMB.2.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctccctgtctgcatctgtagganacagagtcaccatcacttgccgggnaagtcagagctatagcagctaatttaaagttggtatcagacaacgaaaccgaaggggaaacgacccctaaagcctcctagactcttatcgttgctactccgtagtttcgacgtaaaggtcggggtacccccctagtacgtaaacggttccgaaggtcgggacgtagggttagggtaacgttccggttacggggaacctaaggttacttttcctaaaccttcctacccgtaacctaacgttacaacgtacctacggttaccgtacggtaccctaaaaccgtaggttaaacggttaacttttttacggaaccttaaaccgttttaaccttacttacgtaaacctaacgtaacggttaacgttaaaccgtacgttaaccccgttaacgttaaccgtttacgggaccgtacgggggtaacccaaaggtccggttagggaaacgtacgttaaaccgaaaaccggtaaccgttaggtacggtcctaacggaccgtaaccgtttaacg

SEQ ID NO: 355188 - DNA, 668 bp, Homo sapiens
  misc_feature: GZ8MTXP02FIDTQ.21.14.B03.1.454.CMB.2.raw
  modified_base (194)..(194): a, c, t, g, unknown or other
  misc_feature (194)..(194): n is a, c, g, or t
  modified_base (281)..(281): a, c, t, g, unknown or other
  misc_feature (281)..(281): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctccctgtctgcatctgtagganacagactcaccatcacgttggccggacaagtcagagctattagctagtcttaatttaaatggtatcagacaagaaaccgaggaaacncccctaagctcctgacttactattgttgcatccgtagtttagacgtaaaggtcgggaccccctatcgaaaggtttcaaggtcggacgtaggtcgagttcggtagggtaactagttacctttacacccttctacccaacctataccgagtacacggttacctacggacctaaacccgttaggtaaacgtttacgttttacgaccttaaacttttaacccacgttagttaaacccaaacgtaagttaaccgtttaaccgtaacccgttacccccttaagtaaccgtttaacggggacccgtaaaggggaaccaaacggtcgtaagggaactaacgtaaacccgtaaaacgtaccgttagggtaccgtacgtaccgaccacgtttaaccg

SEQ ID NO: 355189 - DNA, 671 bp, Homo sapiens
  misc_feature: GZ8MTXP02JYQ7D.21.14.B03.1.454.CMB.2.raw
  modified_base (277)..(277): a, c, t, g, unknown or other
  misc_feature (277)..(277): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtcctccactcctccctgtctgcatctggtagagacagatcaccatcacttcggccgggacaagtcagagctatagcagtcttaattaatgtatcagacaagaaacgaggaaacncctaagctctgatctagtcgttgctactccgtagttacgacgtaaacggtcgggtaccccagtacgtaggttacgaggttggacgtaggtcggtaacgttcggtaggggaactaggtttactttaccgaaccttcctaaccaacctaacgttacgaaacggtctacgttccgtaacgtaacctaaccgttaagttaaacgtttacttttacgaacctttaaactttaaccgttaccgttaaacgtaaccctaaacgtaaacgttaacgttaacccggtaaacccgttaaccccgtaaacgtaacgtttaccggggaaccggtacgggaacctaaaggtcgtaaggaaactacgtaaaccgtaaacgtacggttgacgcgtacgaccacgttacg

SEQ ID NO: 355190 - DNA, 607 bp, Homo sapiens
  misc_feature: GZ8MTXP02HS3F7.21.14.B03.1.454.CMB.2.raw
  modified_base (314)..(314): a, c, t, g, unknown or other
  misc_feature (314)..(314): n is a, c, g, or t
  modified_base (358)..(358): a, c, t, g, unknown or other
  misc_feature (358)..(358): n is a, c, g, or t
  modified_base (594)..(594): a, c, t, g, unknown or other
  misc_feature (594)..(594): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatccctccctgtctgcatctgtaggagacagacgtcaccatcacgttcggccgggcaagtcagagctatagcagtacttaatttaaacgttgtatcgagacaagaaaccgaagggaaacgcccctaagcctactgtactctatgtnactatcctagttagactaaaggtcggtaccccatacgtagtcgngtacggcaggtcgttagcggttacggacgtaagttactttaccaccttactacccaaaccgtcttacgacgtacgtaacgtttcaacggtacctaacgttagtaaagtttcttttagacctttaaacttactaacgtctaaacgaactaagttacgttaccaacgtacccgtaacgttacgttacgacggaggtaccaaggtcaaggaactacaacaaacggtagtcggtacgacncgtaccacttacg

SEQ ID NO: 355191 - DNA, 647 bp, Homo sapiens
  misc_feature: GZ8MTXP02GO40Q.21.14.B03.1.454.CMB.2.raw
  modified_base (278)..(278): a, c, t, g, unknown or other
  misc_feature (278)..(278): n is a, c, g, or t
  modified_base (304)..(304): a, c, t, g, unknown or other
  misc_feature (304)..(304): n is a, c, g, or t
  modified_base (452)..(452): a, c, t, g, unknown or other
  misc_feature (452)..(452): n is a, c, g, or t
tcagtcgtcgctcgcacgaccggtgctcgatttagtgtgagtagttccgcgggggagtcagtctcagtcaggacacagcatggacatgagggtccccgctcagctccgtggggctcctgctactctggctccgaggtgccagatgtgacatccagatcgacccagtcctccactccctcctgtctgcatcgtgtaggagacagacgtcaccatcacgttcggaccgggacaagtcagacgctagttagctagtacttaatttaaagtggtatacgaanacgaaacgaaaccggaaggtaaaccnccctaagcctcgtagtacttacgtattcgtctacctacgtccgttagttacgacgtaaacgggttccggtacccctagtaccgtaaggtcaggtacgcgtaggtaggacttcgggaagtacagtttacttaccactccgtaacactancgacgacgtctcgtacgtacctaacgtagtaaacgttcttacgaacttactaacttatacgtaactaaagtacgtaactaccgtaaccgtacccgtaacgttaccggtacggaccgtaagggacctaaggtacgacggtaaactaacgtaaaccgtaaacgtacgtcggtaacgtccgtacgaccttaacgttcg

SEQ ID NO: 355192 - DNA, 580 bp, Homo sapiens
  misc_feature: GZ8MTXP02JRIQQ.21.14.B03.1.454.CMB.2.raw
  modified_base (223)..(223): a, c, t, g, unknown or other
  misc_feature (223)..(223): n is a, c, g, or t
  modified_base (233)..(233): a, c, t, g, unknown or other
  misc_feature (233)..(233): n is a, c, g, or t
  modified_base (257)..(257): a, c, t, g, unknown or other
  misc_feature (257)..(257): n is a, c, g, or t
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
  modified_base (307)..(307): a, c, t, g, unknown or other
  misc_feature (307)..(307): n is a, c, g, or t
  modified_base (324)..(324): a, c, t, g, unknown or other
  misc_feature (324)..(324): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
tcagtcgtcgctcgcacgaccggtgctcgatttagtgtgagtagttccgcgggggagtcagtctcagtcaggacacagcatggacatgagggtccccgctcagctcctggggctcctgctactctggctccgaggtgccagatgtgacatccagatgacccagtctccatcctccctgtcctgctatctgtaggagactagagtcaccatcacttggccggtnaaggtcagancattagcagctattaaattgtatnagntaacgaaaccgagggaaacncccgtaagctcctagatactatggttnctacgtacctaggtttnacgtaaacggtcgggacccccctagtcctaaagttccgagtggcaggtggactctaggactgactttccnctctaccactancgagctacgtactacaccacgtagtagtactttacactaacttacgtacttactacaacgtaacgtacgtacctaccgtaacccgtactaccgttaacggaccggtacggaaccacgtacgacggtacgtaacgaacaaaccgtacgtacggtactacgtacaaccgtacgtac

SEQ ID NO: 355193 - DNA, 560 bp, Homo sapiens
  misc_feature: GZ8MTXP01EKWKP.45.87.H10.1.454.CMB.2.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
  modified_base (314)..(314): a, c, t, g, unknown or other
  misc_feature (314)..(314): n is a, c, g, or t
  modified_base (429)..(429): a, c, t, g, unknown or other
  misc_feature (429)..(429): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagggtnttaacagctacttagcctaggtaaccaaacaaaacctggaccaggctcccaggctcatcatctatgacgcatcgaaacngggccacgtggcactcccagcccaggttcagtggcaggtcgggtcctggggacagtacttcaactctcaccatcagcagcctcgaccctgaggtatttcgacctatttactactntcagcagcgtggcggacgagcgctcgtacgttcgggacggaacgggaccgaagggtggaagaactaacgaaaacgacgtggttcgactcgacaccgttattctgttaacttcacttccttccccgctaacg

SEQ ID NO: 355194 - DNA, 510 bp, Homo sapiens
  misc_feature: GZ8MTXP01BX4DT.45.87.H10.1.454.CMB.2.raw
  modified_base (309)..(309): a, c, t, g, unknown or other
  misc_feature (309)..(309): n is a, c, g, or t
  modified_base (487)..(487): a, c, t, g, unknown or other
  misc_feature (487)..(487): n is a, c, g, or t
  modified_base (491)..(491): a, c, t, g, unknown or other
  misc_feature (491)..(491): n is a, c, g, or t
  modified_base (498)..(498): a, c, t, g, unknown or other
  misc_feature (498)..(498): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaacctggccaggctcccaggctcatcatctatgacgcatcgaacngggccagtggcatcccagcccaggttcagtgcagtggtcctgggacagacttcaactctcaccatcagcagcctgaccctgaggtatttgctatttactactgtcagcagcgtggcggacgagcgctcacgttcggcggagggaccgagggtggacgatcaaacgactgttggctgcncatntgtctcnttcctccgctaa

SEQ ID NO: 355195 - DNA, 550 bp, Homo sapiens
  misc_feature: GZ8MTXP01BD5LJ.45.87.H10.1.454.CMB.2.raw
  modified_base (463)..(463): a, c, t, g, unknown or other
  misc_feature (463)..(463): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctaggtaaccaacaaaacctggaccaggctcccaggctcatcatctatgacgcatcgaaacaggggcccaacgtggccaacgtccccagcccgtaggttccaggtcggcaggttgggtcctggggacaggacttcaactctcaccatcagcacgcctcggaccctgagtatttcgcctatttactactgtcagcagcgtcggcggacgagcncgtcacgttcggcggacggacgtaagggtgagataacgaaacgactagcgcgtgacgacatctgttctcgacttcctcccgcgtaac

SEQ ID NO: 355196 - DNA, 524 bp, Homo sapiens
  misc_feature: GZ8MTXP01B8ZJF.45.87.H10.1.454.CMB.2.raw
  modified_base (372)..(372): a, c, t, g, unknown or other
  misc_feature (372)..(372): n is a, c, g, or t
  modified_base (497)..(497): a, c, t, g, unknown or other
  misc_feature (497)..(497): n is a, c, g, or t
  modified_base (521)..(521): a, c, t, g, unknown or other
  misc_feature (521)..(521): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccccgtctttgtttccaggggaaagagccaccctctcctgcagggccagtcagggtgttaacagctacttagcctggtaccaacaaaacctggccaggctcccaggctcatcatctatgacgcatcgaacagggcccactggcatccccagccaggttcagtggcagtgggtctcggggacagacttcactctcnccatcagcagcctggaccctgagtatttgcctatttactacttgtcagcagcgtggcgaccggagcgctcgacttcggcggagggaccgaaggtggagatcgaaacgaacttgtgcgtgcaccgnttctgtctcactccttcccgtccntcg

SEQ ID NO: 355197 - DNA, 541 bp, Homo sapiens
  misc_feature: GZ8MTXP01BKKS7.45.87.H10.1.454.CMB.2.raw
  modified_base (203)..(203): a, c, t, g, unknown or other
  misc_feature (203)..(203): n is a, c, g, or t
  modified_base (379)..(379): a, c, t, g, unknown or other
  misc_feature (379)..(379): n is a, c, g, or t
  modified_base (496)..(496): a, c, t, g, unknown or other
  misc_feature (496)..(496): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagggtgttaacagctacttagcctggtaaccaacaaaacctggccaggctcccaggctcatcatctatgacgcatcgaaacaggggccagtcggcatcccagcccaggttcagtggcaggtggtctgggacagacttcaactctcaaacntcagcagcctgaccctgaggtatttgacctatttactactgtcagcagcgtggcggacgagccgctcgacgttcgggcggtagggaccaaggggtgaacgagtaacaaacgacgtgngggctgccttaccgattctcgtcttcacttccttccccgctaacg

SEQ ID NO: 355198 - DNA, 613 bp, Homo sapiens
  misc_feature: GZ8MTXP01DJ5K1.45.87.H10.1.454.CMB.2.raw
  modified_base (203)..(203): a, c, t, g, unknown or other
  misc_feature (203)..(203): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccggataccaccggagaaattgtgttgacacagtctccagccaccctgtctttgtttccaggggaaangccaccctctcctgcagggccagtcgagggtgttaacagctacttagcctggtaaccaaacaaaactggccaggctcccaggctcatcatctatgacgcatcgaacgagggccacgtggccatccccagccagggttcaggtggcaggtggtctgggacagacttcactctcaaccatcagcacgcctgggaccctgtagtatttcgctatttactacttgtcagcgagcgtacgggccgaccggggacgtccgccttccgtacggtttccgggacggggtaacgggaacccgaagggtacgggaacgaacgtaaccgaaaacggtacgttaggtcggacgtcggaccaacccgttattccgttaagttcctttaacctactttcccgttccccgtccgttaacgttccg

SEQ ID NO: 355199 - DNA, 521 bp, Homo sapiens
  misc_feature: GZ8MTXP01BYT3Z.45.87.H10.1.454.CMB.2.raw
  modified_base (463)..(463): a, c, t, g, unknown or other
  misc_feature (463)..(463): n is a, c, g, or t
  modified_base (493)..(493): a, c, t, g, unknown or other
  misc_feature (493)..(493): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccagggaaagagccaccctctcctgcagggccagtcagggtgttaacagctacttagcctggtaccaacaaaactgcaggctccaggctcatcatctatgacgcatcgaaacagggccactggcatcccagccaggttcagtggcagtgggtcctggggacagactcaactctcaccatcagcacgcccgaccctgaggtatttgcctattactactgtcagcagcgtgcgacggagcgctcgacgttcggcggtaggaccgaggtggagngtacgaaacgacttggtacgcgtgcaccgnttctgtcttcactccttcccgcttcgtc

SEQ ID NO: 355200 - DNA, 524 bp, Homo sapiens
  misc_feature: GZ8MTXP01AB8GJ.45.87.H10.1.454.CMB.2.raw
  modified_base (241)..(241): a, c, t, g, unknown or other
  misc_feature (241)..(241): n is a, c, g, or t
  modified_base (471)..(471): a, c, t, g, unknown or other
  misc_feature (471)..(471): n is a, c, g, or t
  modified_base (487)..(487): a, c, t, g, unknown or other
  misc_feature (487)..(487): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacngctacttagcctggtaccaacaaaactggccaggctcccaggctcatcatctatgacgcatcgaaacaggggccatggcatcccagccaggttcagtgcagtgggtctggggacagtacttcgaactctcaccatcagcagcctggaccctgaggtatttgactatttactactgtcagtcagcgtggcggacgagcgcgtcacgttcggcggagggaccagggtcgagntaacgaaacgacgtgngctggcacgatctgtcttcacttccttcccgcctaac

SEQ ID NO: 355201 - DNA, 560 bp, Homo sapiens
  misc_feature: GZ8MTXP01DC65M.45.87.H10.1.454.CMB.2.raw
  modified_base (235)..(235): a, c, t, g, unknown or other
  misc_feature (235)..(235): n is a, c, g, or t
  modified_base (241)..(241): a, c, t, g, unknown or other
  misc_feature (241)..(241): n is a, c, g, or t
  modified_base (312)..(312): a, c, t, g, unknown or other
  misc_feature (312)..(312): n is a, c, g, or t
  modified_base (404)..(404): a, c, t, g, unknown or other
  misc_feature (404)..(404): n is a, c, g, or t
  modified_base (443)..(443): a, c, t, g, unknown or other
  misc_feature (443)..(443): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtnttaacngctacttagcctggtaccaaacaaaacctggaccaggctcccaggctcatcatctatgacgcatcgaaacngggccactggcatccccagccaggtcagtggcaggtgggtcctggggacagtacttcaacttctcaccatcagcagcctggaccctgaggtntttgctattactactgtcagcagcgtggcggaccgagcncctcgtaccgttcgggacgggtaagggaccgaagggtgacgataacgaaacgttacgtgttcggactcggccgaccttattccgtgttcctttccacttcccttccccgccgttaac

SEQ ID NO: 355202 - DNA, 549 bp, Homo sapiens
  misc_feature: GZ8MTXP01EQTBU.45.87.H10.1.454.CMB.2.raw
  modified_base (201)..(201): a, c, t, g, unknown or other
  misc_feature (201)..(201): n is a, c, g, or t
  modified_base (233)..(233): a, c, t, g, unknown or other
  misc_feature (233)..(233): n is a, c, g, or t
  modified_base (401)..(401): a, c, t, g, unknown or other
  misc_feature (401)..(401): n is a, c, g, or t
  modified_base (521)..(521): a, c, t, g, unknown or other
  misc_feature (521)..(521): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgttccaggggaanagccaccctctcctgcagggccagtcagggtnttaacagctactagcctggtaaccaacaaaactggccaggcctccaggctcatcatctatgacgcatcgaaacacggggccacgtggcactccccagcccaggttcagtggcaggtgggtctgggacagtcttcaactctcaccatcagcagcctagaccctgaggtntttgccttatttactacttgtcagcagcgtcggcggacgagccgcgtcgtacgttcggacggtacgggaccgtagggtgagacgtaacgaaacggttacgtggttgcgtcgccgaccttntctcgttcttctccttccctcccgctcg

SEQ ID NO: 355203 - DNA, 537 bp, Homo sapiens
  misc_feature: GZ8MTXP01CH6YC.45.87.H10.1.454.CMB.2.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
  modified_base (309)..(309): a, c, t, g, unknown or other
  misc_feature (309)..(309): n is a, c, g, or t
  modified_base (438)..(438): a, c, t, g, unknown or other
  misc_feature (438)..(438): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagggtnttaacagctacttagcctggtaccaacaaaacctggccaggctccaggctcatcatctatgacgcatcgaaacngggccagtggcatcccagcccaggtcagtggcaggtggtcctgggacagacttcaactctcacatcagcagcctacgaccctgagtatttgcctatttactactgtcagcagcgtcggcggacgagccnctcgtacgttcgggcggtacggaccgtaagggtcgagagtaacaaacgacgtgttcggctgccacacgttctgttccttcacttcccttcccgcttaac

SEQ ID NO: 355204 - DNA, 530 bp, Homo sapiens
  misc_feature: GZ8MTXP01DKOKC.45.87.H10.1.454.CMB.2.raw
  modified_base (410)..(410): a, c, t, g, unknown or other
  misc_feature (410)..(410): n is a, c, g, or t
  modified_base (499)..(499): a, c, t, g, unknown or other
  misc_feature (499)..(499): n is a, c, g, or t
  modified_base (505)..(505): a, c, t, g, unknown or other
  misc_feature (505)..(505): n is a, c, g, or t
  modified_base (509)..(509): a, c, t, g, unknown or other
  misc_feature (509)..(509): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccagggaaagagccaccctctcctgcagggccagtcagggtgttaacagctaacttagcctggtaaccaacaaaaacctggaccaggcctcccaggctcatcatctatgacgcatcgaaacagggccactcggcactccccagcccaggttcagtggcaggtgggtcctggggacaggtacttcgaactctcaccatcagcagcctggaccctgagtntttcgctatttactactgtcagcagcgtcggcggacgagcgctcgtacgttcggcggaggacctaagggtgagataacaaacgactggngctgcncatntgtcttcacgttcctccgctc

SEQ ID NO: 355205 - DNA, 548 bp, Homo sapiens
  misc_feature: GZ8MTXP01AKP4C.45.87.H10.1.454.CMB.2.raw
  modified_base (201)..(201): a, c, t, g, unknown or other
  misc_feature (201)..(201): n is a, c, g, or t
  modified_base (439)..(439): a, c, t, g, unknown or other
  misc_feature (439)..(439): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgttccaggggaanagccaccctctcctgcagggccagtcagggtgttaacagctacttagcctggtaccaacaaacctggccaggctcccaggctcatcatctatgacgcatcgaacagggccatggcatcccagccaggttcagtgcaggtggtcctgggacagtacttcaactctcaccatcagcagcctggaccctgacggtattttcggacctagtttactactgtcagtcaggcgtggcggtacgngcgctctacgttcgggcggtacgggaccaagggtcggacgagtaaccgaaacggacgtggacggctcggccacgttatctacgtcttcacttccttaaccccgctaacg

SEQ ID NO: 355206 - DNA, 573 bp, Homo sapiens
  misc_feature: GZ8MTXP01DQZ0X.45.87.H10.1.454.CMB.2.raw
  modified_base (236)..(236): a, c, t, g, unknown or other
  misc_feature (236)..(236): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccgaggggaaagagccaccctctcctgcagggccagtcagggtnttaacagctacttagcctaggtaaccaaacaaaaacctggaccaggcctcccaggctcatcatctaatgacgcatcgaaacagggcccacgtggacatccccagccctaaggttcaggtggcgaggtgggtcctggggacagtaccttcaaactctcacatacagcagcctcggaccctgaggtatttcgaccttatttactactgtcagcagcgtggccgggacgagccgcgtcgtacgttcgggcgggtaacgggaccgtaagggtggaacgaagtaacgaaacgacgtgacggtctcgaccgcttatcttgtcttcacttccttcccgcttaac

SEQ ID NO: 355207 - DNA, 542 bp, Homo sapiens
  misc_feature: GZ8MTXP01AJ1ER.45.87.H10.1.454.CMB.2.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
  modified_base (352)..(352): a, c, t, g, unknown or other
  misc_feature (352)..(352): n is a, c, g, or t
  modified_base (398)..(398): a, c, t, g, unknown or other
  misc_feature (398)..(398): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaangccaccctctcctgcagggccagtcagggtgttaacagctacttagcctggtaccaacaaaactggccaggctcccaggctcatcatctatgacgcatcgaaacngggccactggcactcccagcccaggttcagtggcaggtgggtcngggacagtacttcaactctcaccatcagcagcctggaccctgagtntttcgcctatttactactgtcagcagcgtcggcggacgagcgctcgacgttcgggacggacgggaccgtaagggtggagacgtaacgaaacgacggtgcggctcggacgttccatctgtcttcacttccttcccgttctaaccg

SEQ ID NO: 355208 - DNA, 612 bp, Homo sapiens
  misc_feature: GZ8MTXP01C2CUX.45.87.H10.1.454.CMB.2.raw
  modified_base (239)..(239): a, c, t, g, unknown or other
  misc_feature (239)..(239): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccgaggggaaagacgcccaccctctcctgcagggccagtcgagggtnttaacagctactagcctaggtaaccaaacaaaacctggaccaggcctcccgaggctcatcatctatgacgcatacgaacgacgggccacgtcggcactccccgagcccgtaggtcaggtcggacgtaggtcgggtccgtggggacagtacctcaacttctccaccatcagcacgtccgtcggaccctggtacggtatttcgacttatttactacttgtcagcgaggcggtcggaccggacggacgccgtcgtccgtacggttcggggacgggtacgggaccgtaaggggtgacgactaacgaaacgacgtggcggtctcggacccttcgttacttccgttacgttccttactcttcccgttcccgcgttaacg

SEQ ID NO: 355209 - DNA, 590 bp, Homo sapiens
  misc_feature: GZ8MTXP01CSYKN.45.87.H10.1.454.CMB.2.raw
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
  modified_base (298)..(298): a, c, t, g, unknown or other
  misc_feature (298)..(298): n is a, c, g, or t
  modified_base (428)..(428): a, c, t, g, unknown or other
  misc_feature (428)..(428): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgttccaggggaaangcccaccctctcctgcagggccagtcagggtnttaacngctactagcctaggtaccaacaaaactggccaggctcccaggctcatcatctatgacncatcgaacaggggcccacgtggcatccccagccctaggttcagtggcaggtgggtcctgggacagacttcgaactctcaccatcagcacgccgtacggaccctgaggtatttcgaccttatttactactntacgacgcaggcgtcggaccgggaccgacggccgccttacgtaccgtttcgggacgggacgggaccgtaagggtaggagaacgtaacgaaaccggaagtcggagggtcctggccaaccgttcttctcggttaacctttcacttccgttccccgcttaacccg

SEQ ID NO: 355210 - DNA, 544 bp, Homo sapiens
  misc_feature: GZ8MTXP01DRY3G.45.87.H10.1.454.CMB.2.raw
  modified_base (203)..(203): a, c, t, g, unknown or other
  misc_feature (203)..(203): n is a, c, g, or t
  modified_base (236)..(236): a, c, t, g, unknown or other
  misc_feature (236)..(236): n is a, c, g, or t
  modified_base (312)..(312): a, c, t, g, unknown or other
  misc_feature (312)..(312): n is a, c, g, or t
  modified_base (463)..(463): a, c, t, g, unknown or other
  misc_feature (463)..(463): n is a, c, g, or t
  modified_base (529)..(529): a, c, t, g, unknown or other
  misc_feature (529)..(529): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanacgccaccctctcctgcagggccagtcagggtnttaacagctacttagcctggtaccaaacaaaacctggaccaggctccaggctcatcatctatgacgcatcgaaacntggccacgtggcactccagcagttcagtggcagtcgggtctggggacagtcttcactctcaaccatcagcagccctggaccctggaggtatttcgcctaatttactatgtcagcagcgtggggcgtacgagcgctcgtacgttcggacggngggtaccgaagggtggagaatacgaaacgtaagttgtaggcttacgcttacctaatctgttacctnacttccttaacccgc

SEQ ID NO: 355211 - DNA, 535 bp, Homo sapiens
  misc_feature: GZ8MTXP01EZEF5.45.87.H10.1.454.CMB.2.raw
  modified_base (359)..(359): a, c, t, g, unknown or other
  misc_feature (359)..(359): n is a, c, g, or t
  modified_base (476)..(476): a, c, t, g, unknown or other
  misc_feature (476)..(476): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctaggtaccaaacaaaaacctggccaggctcccaggctcatcatctatgacgcatcgaacagggccacgtggcatcccagcccaggttcagtgcaggtggctgggacngacttcaactctcacatcagcagcctcggaccctgaggtatttgcctatttactactgcagcagcgtggcgacgagcgctcgtacgttcggacgggacggaccgtaaagggtgaagntaacgaaacgaacgtggttaggctcggcaccatctgtcttcacttccttccccgctaac

SEQ ID NO: 355212 - DNA, 563 bp, Homo sapiens
  misc_feature: GZ8MTXP01D0QVD.45.87.H10.1.454.CMB.2.raw
  modified_base (202)..(202): a, c, t, g, unknown or other
  misc_feature (202)..(202): n is a, c, g, or t
  modified_base (235)..(235): a, c, t, g, unknown or other
  misc_feature (235)..(235): n is a, c, g, or t
  modified_base (301)..(301): a, c, t, g, unknown or other
  misc_feature (301)..(301): n is a, c, g, or t
  modified_base (513)..(513): a, c, t, g, unknown or other
  misc_feature (513)..(513): n is a, c, g, or t
  modified_base (523)..(523): a, c, t, g, unknown or other
  misc_feature (523)..(523): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccagggaaanagccaccctctcctgcagggccagtcgagggtnttaacagtctacttagcctggtaaccaacaaaacctggaccaggctccagctcatcatctatgacncatcgaaacagggccagtcggacactcccagcccaggttcagtgcgaggtggtcctgggacagacttcaacctctcaccatcacgcagcctgaccctgtagtatttcgcttatttactactgtcagtcagcgtggaccggtacgagtccgctcgtaccgttgggacgggaacggacggtaagggtggaagactaacgaaacgttacgtcggngcgtcgaccncgttactcgtagttccttctacttcccgttcccgctaacg

SEQ ID NO: 355213 - DNA, 577 bp, Homo sapiens
  misc_feature: GZ8MTXP01DR4WP.45.87.H10.1.454.CMB.2.raw
  modified_base (358)..(358): a, c, t, g, unknown or other
  misc_feature (358)..(358): n is a, c, g, or t
  modified_base (457)..(457): a, c, t, g, unknown or other
  misc_feature (457)..(457): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctaggtaaccaaacaaaacctggaccaggctcccaggctcatcatctatgacgcatcgaaacacgggccactcggcatcccagccaggttcagtggcaggtggtccngggacagtacttcaactctcaccatcagcacgccgtcggaccctgtacggtatttcgaccttatttactactgtacagcgagcggtcggcggaaccggngccgtctacgtcgttcgggacgggaagggaccgtaagggtggagtactaacaaacggcgtaggttggacgtgccttacgttacttcgtacgtcctttacgacttcccttcccgctaaccg

SEQ ID NO: 355214 - DNA, 631 bp, Homo sapiens
  misc_feature: GZ8MTXP01EABNU.45.87.H10.1.454.CMB.2.raw
  modified_base (204)..(204): a, c, t, g, unknown or other
  misc_feature (204)..(204): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccgaggggaaanagccaccctctcctgcagggccagtcgtagggtnttaacngtctacttagcctaggtaaccaaacaaaacctggaccaggcctccaggctcatcatctatgacgcatacgaaacacggggccacgtggacactcccagccaggttcagtggcaggtggtcctggggacagtacttcaaacctctcaccatacagcacgccgtacggaccctgtaggtactttgacctattttacgtacttgtacagcagcgtcggcgacgagccgtctcgtacgttcgggacgggtaacgggaccgtaaggggtaggaacgtaagtaaaccgtaaacggaaacgttcgggttacggtaccgtcggaccaccggttaacttccgttacggttccttttaccgtacctttccccggtttaaccccgccgtttaaacccg

SEQ ID NO: 355215 - DNA, 601 bp, Homo sapiens
  misc_feature: GZ8MTXP01AERRA.45.87.H10.1.454.CMB.2.raw
  modified_base (203)..(203): a, c, t, g, unknown or other
  misc_feature (203)..(203): n is a, c, g, or t
  modified_base (234)..(234): a, c, t, g, unknown or other
  misc_feature (234)..(234): n is a, c, g, or t
  modified_base (293)..(293): a, c, t, g, unknown or other
  misc_feature (293)..(293): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccacctctcctgcagggccagtcagggtnttaacagctatagctaggtaccaacaaaactggcaggctccagctcatcatctatgacncatcgaacacgggccagtgcactccagccaggttcaggtcgcaggtggtctaggggcagtaccttcaaccttctcacatcaagcagcccgtacggaccctagaggtatttcgaccttatttactacttcgtacagctagacgtcggacggggacgacgtcgacgtctaccgttcgggacgggtaacgggaccgtaagggtaggaacgaacgtaaccgaaaacggttaacgtcgggttacgacgttcgaccgttaccgttacgttccgttggttcctttacgacctttcccgttccccgcgtttaaccg

SEQ ID NO: 355216 - DNA, 728 bp, Homo sapiens
  misc_feature: GZ8MTXP01C1BNX.45.87.H10.1.454.CMB.2.raw
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgttccgaggggaaagagcccaccctctcctgcagggccagtcagggtgttaacagctactagcctggtaccaacaaaactggccaggctccaggctcatcatctatgacgcatcgaacagggtccacgtggcactcccagccgtaggttcaggtggaccgtaggtcggggtacctagggggacacggtaaccttcaaaccttctccacctaactaccaggcctaacggcccgttacgggaaccccgtaggtacgggtaactttttcggacccttaacttttaccttaaccgtggttaccaacgtcgtaacggccgggttacgggacccggggaaccggtaaccggccgtcccgtaacgtcccggtttaccggggacggggaaccgggggtaacccgaaagggggttacggaaacgggtaacgtaaaccgtaaaaccgggaaaccttggggttaacggccgttaacgggacccgaaccgttaacgttccttaccggttcctttaaccgtacctttccccgttccccgaacccgtttaaccg

SEQ ID NO: 355217 - DNA, 579 bp, Homo sapiens
  misc_feature: GZ8MTXP01EHLO5.45.87.H10.1.454.CMB.2.raw
  modified_base (203)..(203): a, c, t, g, unknown or other
  misc_feature (203)..(203): n is a, c, g, or t
  modified_base (318)..(318): a, c, t, g, unknown or other
  misc_feature (318)..(318): n is a, c, g, or t
  modified_base (411)..(411): a, c, t, g, unknown or other
  misc_feature (411)..(411): n is a, c, g, or t
  modified_base (428)..(428): a, c, t, g, unknown or other
  misc_feature (428)..(428): n is a, c, g, or t
tcagacgcgatcgacacgaccggtgctcgatttagcagtactgcgttggggtttgggggaggaactgctcagttaggacccagagggaaccatggaagccccagctcagcttctcttcctcctggcactctggctcccagataccaccggagaaattgtgttgacacagtctccagccaccctgtctttgttccaggggaaanagccaccctctcctgcagggccagtcagggtgttaacagctacttagcctaggtaaccaaacaaaaacctggaccaggcctccgaggctcatcaatctaatgacgcatcgaaacngggccagtgacactcccagcctaggttcagtgcgagtgggtctggggacagtacttcaactctcaccagtcagcacgccgtagacctgaggtnttgcctatttactactntcagcagcgtcggcggacgagtcgctcgtacgttcgggacgggtaacgggaccgagggtaggaacgaagtaaccgaaaacggttacgtaggttcggcgtaggaccgaccttattcttcgttaacctttccacttcccttccccgcttaacg

SEQ ID NO: 355218 - DNA, 675 bp, Homo sapiens
  misc_feature: GZ8MTXP01AMV4I.45.87.H10.1.454.CMB.2.raw
  modified_base (334)..(334): a, c, t, g, unknown or other
  misc_feature (334)..(334): n is a, c, g, or t
tcagacgcgatcgacacgaccggtgctcgatttagcagtactgcgttgggtttgggggagctacaacaggcaggcaggggcagcaagatggtgttgcagaccccaggtcttcatttctctgttgctctggatctctggtgcctacggggacatcgtgatgacccagtctccagactccctggctgtgtctcgtgggcgagacgggccaccatacaactgacaacgtccagccagagttgtttagacagctaccaaacaataaagaacttactagtcgttaggtaccagacaacgaaaccgagtcagaccctacctaagctgctactatttacgnggactacgtccgtaacccgggtacgtccccggggtccccctacggaccgtacgttacgaggtcgggaccgtcgggtcggggtacccgtgggaactaacggttaactttccgaacttcctacaaccctacgtcgaacggctacggcctacgcgtaggcgtaagaacggtagtgggggtagggtcttaagtttacgtgtacgttgtacgaatacttaaatttatttaacttacgttaactttccccgttacggttaccgtttccgggaccccgttagggaaacccgttaaggttacggtaacttactaaaccgtaaaacggtcgttacggttcgcgtaacccg

SEQ ID NO: 355219 - DNA, 632 bp, Homo sapiens
  misc_feature: GZ8MTXP01C3P1X.45.87.H10.1.454.CMB.2.raw
  modified_base (235)..(235): a, c, t, g, unknown or other
  misc_feature (235)..(235): n is a, c, g, or t
  modified_base (316)..(316): a, c, t, g, unknown or other
  misc_feature (316)..(316): n is a, c, g, or t
  modified_base (594)..(594): a, c, t, g, unknown or other
  misc_feature (594)..(594): n is a, c, g, or t
  modified_base (615)..(615): a, c, t, g, unknown or other
  misc_feature (615)..(615): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtcttttgttccaggggaaagagccaccctctcctgcagggccagtcagggtntaacagctattagcctaggtaaccaacaaaacctggacccaggcctcccaggctcatcatctaatcgacgcaatcgaaacngggaccagtcgcactcccagccctaggttcaggtcggctaggtcgggtcgtaggggacagtaccttcaaaccttcctcacctataccaacgccaacggtcccgtacgggtaccctggtaagttacttttcgccctttaactttactaccgttgtacgaagcgtaggcggttacggacggggtacccgaggtcctcgtacgtaccgttccggggacgggaaacgggtaccgtaaagggggtcgaacgtaaacgtaacgtaaacggacgttggcggtacngaccttcattgtacttctacncgttcctaacccgcctg

SEQ ID NO: 355220 - DNA, 678 bp, Homo sapiens
  misc_feature: GZ8MTXP01AZWKB.45.87.H10.1.454.CMB.2.raw
  modified_base (203)..(203): a, c, t, g, unknown or other
  misc_feature (203)..(203): n is a, c, g, or t
  modified_base (359)..(359): a, c, t, g, unknown or other
  misc_feature (359)..(359): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcaggtgttaacagctacttagcctaggtaccaacaaaacctggaccaggctcccaggctcatcatctatgacgcatcgaacagggccacgtggcatcccagcccaggttcagtgcagtgggtcctgggacngacttcaactctcaccatcgacgcacgtcctacgggacccgtagaggtactttggacccttaagtttaacctacgtacgttacgaacggcctaacggtcggttaccgggaccggtacccggaacggcccggttacctacccgttaacggtttccggggaccggggaaccggggtaaacccggaaggggttaggacgttaaacgaaccggtaaaacgttaccggttagggttcggaccgttacggacccgttaacgttaaccgttccggttacgttcccgttaccgtacgtttcccttccccggttaacccgttaaccgg

SEQ ID NO: 355221 - DNA, 752 bp, Homo sapiens
  misc_feature: GZ8MTXP01BCC4W.45.87.H10.1.454.CMB.2.raw
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgttccaggggaaagacgccaccctctcctgcagggccagtcgagggttgttaacagtactacttagcctaggtaaccaaacaaaactcggaccaggcctccgaggctcactacatctagtcgacgcaatccgaaacgacgggcccaacgtcggacactccccgagcccgtaaggttccagttggcgtagggtcgggtcccgaggggactacgtaccttccgaaaccttcccgtcacctacgtcgacgccgtacggccttacgggaccctaggtaacgggtttactttcgtaccttaagttttacccgtaacttcgtacgacgtcgaacgggtccgggttaccgggaccgggacccggacgggtacccgtccgttaccgtaaccgggtttccgggggaaccggggtaaaccggggtaaacccggtaaaggggttacggaaacggtaaaccgtaaaccggaaaacggttcgtacggttacggtccgtacggttacccgttaaccttcgttaaccgttcggtttccttaaccgtcctttccccggttaaccccttaacgtttaaccg

SEQ ID NO: 355222 - DNA, 524 bp, Homo sapiens
  misc_feature: GZ8MTXP02GKQG7.45.87.H10.1.454.CMB.2.raw
  modified_base (392)..(392): a, c, t, g, unknown or other
  misc_feature (392)..(392): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaacctggccaggctcccaggctcatcatctatgacgcatcgaacagggccactggcatcccagccaggttcagtgcaggtggtcctggggacagactcactctcacatcagcagcctgaccctgagtntttgctatttactactgtcagcagcgtggcgaccgagcgctcacgtttcggcgggtacgggaccgagggtcggagagtacgaaaacggactcggtaggctcgcaccatcgtcgtcttcatccttcccgctac

SEQ ID NO: 355223 - DNA, 516 bp, Homo sapiens
  misc_feature: GZ8MTXP02HL7F6.45.87.H10.1.454.CMB.2.raw
  modified_base (203)..(203): a, c, t, g, unknown or other
  misc_feature (203)..(203): n is a, c, g, or t
  modified_base (357)..(357): a, c, t, g, unknown or other
  misc_feature (357)..(357): n is a, c, g, or t
  modified_base (512)..(512): a, c, t, g, unknown or other
  misc_feature (512)..(512): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagggtgttaacagctacttagcctggtaccaacaaaacctggccaggctcccaggctcatcatctatgacgcatcgaacaggggccactggcatcccagcccaggttcagtgcagtggtcctgggacngacttcactctcaccatcagcagcctgaccctgagtatttgctatttactactgtcagcagcgtggcgaccgagcgctcacgttcggcggaggaccgaaggtaggagagtacaaaacgaactgtacggctcgacaccatctgtcttcatcctccnctac

SEQ ID NO: 355224 - DNA, 522 bp, Homo sapiens
  misc_feature: GZ8MTXP02JGO1H.45.87.H10.1.454.CMB.2.raw
  modified_base (436)..(436): a, c, t, g, unknown or other
  misc_feature (436)..(436): n is a, c, g, or t
  modified_base (482)..(482): a, c, t, g, unknown or other
  misc_feature (482)..(482): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgttccatgggaaagagccaccctctcctgcagggccagtcagggtgttaacagctacttagcctggtaccaacaaaacctggccaggctcccaggctcatcatctatgacgcatcgaacagggccactggcatccccagccaggttcagtggcaggtgggtctgggacagcttcactctcacatcagcagcctgaccctgaggtatttcgcctatttactactgtcacgcagcgtggcgacgagcgcnctacgttcggcggaggaccgaagggtgagatacgaaacgaacgtgnggctcgacaccgaatcgtacgttctcacttccgttccacc

SEQ ID NO: 355225 - DNA, 524 bp, Homo sapiens
  misc_feature: GZ8MTXP02JVGGL.45.87.H10.1.454.CMB.2.raw
  modified_base (417)..(417): a, c, t, g, unknown or other
  misc_feature (417)..(417): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaacctggccaggctcccaggctcatcatctatgacgcatcgaacagggccatggcatcccagccaggttcagtggcagtgggtcctggggacagacttcactctcaccatccagcagcctggaccctgagattttgcctatttacactgtcancagcgtggcgacgagcgctcgactttcgggcggaggaccgaagggtgagactacaaaacgactggtggctcgaccaccatcctgtccttcacttccttcccgctacg

SEQ ID NO: 355226 - DNA, 557 bp, Homo sapiens
  misc_feature: GZ8MTXP02JS7P9.45.87.H10.1.454.CMB.2.raw
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaacctggccaggctcccaggctcatcatctatgacgcatcgaacagggccactggcatcccagccaggttcagtgcaggtggtcctgggacagacttcactctcaccatcagcagcctggaccctgagtatttgcctatttactactgtcagcagcgtggcgacgagcgcgtctaccgtttcgggcgggtagggacccgaaggggtggagaacgttacgaaaacggtacgtggtacggacgtcggacccaacctatccgtacgttccttacacttccctttcccgaccttacg

SEQ ID NO: 355227 - DNA, 509 bp, Homo sapiens
  misc_feature: GZ8MTXP02FMIVQ.45.87.H10.1.454.CMB.2.raw
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccctgtctttgttccaggggaagagccaccctctcctgcagggccagtcagggtgttaacagctacttagcctggtaccaacaaaacctggccaggctcccaggctcatcatctatgacgcatcgaacaggggccactggcatccccagcccaggttcagtggcagtgggtcctgggacagacttcactctcaccatcagcagcctggaccctgaggatttgcctatttacactgtcagcagcgtggcgacgagcgctcactttcggcggagggaccaaggtgagatcaaacgactgtaggctgcaccatcgtgtcttcatcttcccgctac

SEQ ID NO: 355228 - DNA, 534 bp, Homo sapiens
  misc_feature: GZ8MTXP02IH3OU.45.87.H10.1.454.CMB.2.raw
  modified_base (202)..(202): a, c, t, g, unknown or other
  misc_feature (202)..(202): n is a, c, g, or t
  modified_base (494)..(494): a, c, t, g, unknown or other
  misc_feature (494)..(494): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaanagccaccctctcctgcagggccagtcagggtgttaacagctacttagcctggtaccaacaaaacctggccaggctcccaggctcatcatcatgacgcatcgaaacaggggccacgtggccatccccagcccaggttcagtggcaggtggtctggggacagacttcactctcaccatccagcagcctggaccctgagtatttgacctatttactactgtcagtcaggcgtggaccgaccgagccgctccacgtttcggacggacgggaccaagggtggagatacgaaaagacngtaggctgacaccatcgtgtcttcacttccttccgactac

SEQ ID NO: 355229 - DNA, 558 bp, Homo sapiens
  misc_feature: GZ8MTXP02IS4KA.45.87.H10.1.454.CMB.2.raw
  modified_base (235)..(235): a, c, t, g, unknown or other
  misc_feature (235)..(235): n is a, c, g, or t
  modified_base (372)..(372): a, c, t, g, unknown or other
  misc_feature (372)..(372): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtnttaacagctacttagcctggtaccaacaaaactggccaggctccaggctcatcatctatgacgcatcgaacagggccatggcatccagccaggttcagtgcaggtggtcctgggacagacttcactctcaccatcancagcctgaccctgagtatttgcctaatttactactgtacagtcagcgtggaccgacggagcgctctacgttcgggacggtacgggaaccgaagggtaggagaacgtacgaaaacgaaccgtaggtacggacgtacgaccgaaccacttcgtcgttacttactacttcccgttaccccgtaccgtac

SEQ ID NO: 355230 - DNA, 524 bp, Homo sapiens
  misc_feature: GZ8MTXP02HPYT0.45.87.H10.1.454.CMB.2.raw
  modified_base (461)..(461): a, c, t, g, unknown or other
  misc_feature (461)..(461): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaaccaaacaaaaacctggaccaggctccccaggctcatcatctatgacgcatcgaacagggccactggcatccccagccaggttcagtggcagtggctggggacagacttcactctcacatcagcagcctgaccctgaggtatttgctatttactactgtcagcagcgtgcgacgagcgctcacgttcggcggaggaccgaaggnggaagatacgaaaacgaacgtgtggctcgaccaccatcgtgtcttcacttccttccgacctac

SEQ ID NO: 355231 - DNA, 518 bp, Homo sapiens
  misc_feature: GZ8MTXP02HPB74.45.87.H10.1.454.CMB.2.raw
  modified_base (202)..(202): a, c, t, g, unknown or other
  misc_feature (202)..(202): n is a, c, g, or t
  modified_base (361)..(361): a, c, t, g, unknown or other
  misc_feature (361)..(361): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagggtgttaacagctacttagcctggtaccaacaaaacctggccaggctcccaggctcatcatctatgacgcatcgaacagggccactggcatcccagccaggttcagtgcagtgggtcctgggacagacttnactctcaccatcagcagcctggaccctgaggtatttgcctatttactactgtcagcagcgtgcgacgagcgctcacgtttcggcggagggaccgaaggtggaagacgtacgaaaacgacgtagtggctcgcaccatcgtgtcttcactctccgctac

SEQ ID NO: 355232 - DNA, 520 bp, Homo sapiens
  misc_feature: GZ8MTXP02F0F8K.45.87.H10.1.454.CMB.2.raw
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaacctggccaggctcccaggctcatcatctatgacgcatcgaacagggccactggcatcccagcccaggttcagtggcaggtggtcctggggacagacttcactctcaccatcagcagcctggaccctgaggatttgcctatttacactgtcagcagcgtggcgaccgagcgctcacgttcgggcggagggaccaggtggagatacgaaaacgaactgtaggctgacaccgatcgtgtcttcacttccttccgctac

SEQ ID NO: 355233 - DNA, 529 bp, Homo sapiens
  misc_feature: GZ8MTXP02FP0XR.45.87.H10.1.454.CMB.2.raw
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgttccaggggaaagagccaccctctcctgcagggccagtcagggtgttaacagctacttagcctggtaccaaacaaaacctggccaggctcccaggctcatcatctatgacgcatcgaacaggggccacgtggcatcccagcccaggttcaggtggcaggtgggtctgggacagacttcactctcaccatcagcagcctgaccctgaggtatttcgctatttactactgtcagcagcgtggcgacgagccgctcaccgttcggacggacgggaccgaagggtgagactacgaaaacgactggtaggctcgacaccatcgtgtcttcactccttcccgctac

SEQ ID NO: 355234 - DNA, 521 bp, Homo sapiens
  misc_feature: GZ8MTXP02JL0M4.45.87.H10.1.454.CMB.2.raw
  modified_base (203)..(203): a, c, t, g, unknown or other
  misc_feature (203)..(203): n is a, c, g, or t
  modified_base (308)..(308): a, c, t, g, unknown or other
  misc_feature (308)..(308): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagggtgttaacagctacttagcctggtaccaacaaaacctggccaggctcccaggctcatcatcatgacgcatcgaacngggccactggcatcccagccagttcagtgcagtggcctgggacagacttcactctcaccatcagcagcctcgacctgagtatttgctattactactgtcagcagcgtggcgacgagcgctcacgttcggcggtacggaccgaagggtcggagacgtacgaaaacgtacgtcggtagctacgacaccatcgtacgtctcactcctccgactacg

SEQ ID NO: 355235 - DNA, 555 bp, Homo sapiens
  misc_feature: GZ8MTXP02HF5NY.45.87.H10.1.454.CMB.2.raw
  modified_base (203)..(203): a, c, t, g, unknown or other
  misc_feature (203)..(203): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagggtgttaacagctacttagcctggtaccaacaaaacctggccaggctcccaggctcatcatctatgacgcatcgaacacgggccactggcatcccagccaggttcagtgcaggtggtcctgggacagcttcactctcaccatcagcacgcctggaccctgacggtatttgacctatttactactgtcagctagcgtcggacgaccgagcgctccgtacgttcgggacggacggggaccaagggtaggaagacgtaacgaaacgtacgtcggtcggactcgaccactacgtctcggtcctactacgttcctaccccggtactacg

SEQ ID NO: 355236 - DNA, 536 bp, Homo sapiens
  misc_feature: GZ8MTXP02GN4W5.45.87.H10.1.454.CMB.2.raw
  modified_base (203)..(203): a, c, t, g, unknown or other
  misc_feature (203)..(203): n is a, c, g, or t
  modified_base (396)..(396): a, c, t, g, unknown or other
  misc_feature (396)..(396): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagggtgttaacagctacttagcctggtaaccaacaaaacctggccaggctcccaggctcatcatctatgacgcatcgaacagggccacgtggcactccccagccaggttcagtggcaggtgggtctgggacagacttcactctcaccatcagccagtcctagacccngacggtatttcgcctatttactactgtcagcagcgtggcgaccgagcgctcacgttcggcggagggaccgaagggtcggagatacgaaaacgaacgtagtggactcgacaccgatcgtgtacttcactccttcccgctac

SEQ ID NO: 355237 - DNA, 531 bp, Homo sapiens
  misc_feature: GZ8MTXP02IW63Z.45.87.H10.1.454.CMB.2.raw
  modified_base (360)..(360): a, c, t, g, unknown or other
  misc_feature (360)..(360): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctggtaccaacaaaacctggccaggctcccaggctcatcatctatgacgcatcgaacagggccactggcatcccagccaggttcagtgcaggtggtctggacagacttnacctctcaccatcagcacgcctcgaccctgaggtatttgctatttactactgtcagcagcgtggcgaccgagcgctcacgttcggcggacggacgagggtggagagtacgaaaacgaacgtgtacggctacgacgacctagtcgtcgtacttacattccctttccgactac

SEQ ID NO: 355238 - DNA, 571 bp, Homo sapiens
  misc_feature: GZ8MTXP02HTMIX.45.87.H10.1.454.CMB.2.raw
  modified_base (235)..(235): a, c, t, g, unknown or other
  misc_feature (235)..(235): n is a, c, g, or t
  modified_base (309)..(309): a, c, t, g, unknown or other
  misc_feature (309)..(309): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtnttaacagctacttagcctggtaccaacaaaacctggccaggctcccaggctcatcatctatgacgcatcgaacnggggccacgtggccatccccagcctaggttcaggtggcaggtgggtccgtggggacaggtacttcacctctccaacctatccagccaacgtccctacggacccgtgacggttattttcgaccttaattttactacttgtcagacagcgtggccgacgagccgtacctcgtacgtttcgggcgggacggaccgagggtagagtaactacgaaaacggacttggagctcgaccaccgatcgtgtacttcatcccttaccgctac

SEQ ID NO: 355239 - DNA, 545 bp, Homo sapiens
  misc_feature: GZ8MTXP02JQTVK.45.87.H10.1.454.CMB.2.raw
  modified_base (202)..(202): a, c, t, g, unknown or other
  misc_feature (202)..(202): n is a, c, g, or t
  modified_base (363)..(363): a, c, t, g, unknown or other
  misc_feature (363)..(363): n is a, c, g, or t
  modified_base (430)..(430): a, c, t, g, unknown or other
  misc_feature (430)..(430): n is a, c, g, or t
  modified_base (460)..(460): a, c, t, g, unknown or other
  misc_feature (460)..(460): n is a, c, g, or t
  modified_base (538)..(538): a, c, t, g, unknown or other
  misc_feature (538)..(538): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtcttttgttccaggggaanagccaccctctcctgcagggccagttcagggtgttaacagctacttagcctggtaccaacaaaacctgccaggctcccaggctcatcatctatgacgcatcgaacaggggcccactggcatccccagcccaggttcagtggcaggtgggtccctggggacngacttcactctcaccatcagcagcctaggaccctgacggtatttgcctatttactactgtcagcagngtggcgaccgagcgctcgactttcggcggngggaccgaagggtacgggagaacgtacgaaacgaacgtgtacggctacggccacatctgttcttctacttccttcccncctaccg

SEQ ID NO: 355240 - DNA, 570 bp, Homo sapiens
  misc_feature: GZ8MTXP02JICTF.45.87.H10.1.454.CMB.2.raw
  modified_base (201)..(201): a, c, t, g, unknown or other
  misc_feature (201)..(201): n is a, c, g, or t
  modified_base (234)..(234): a, c, t, g, unknown or other
  misc_feature (234)..(234): n is a, c, g, or t
  modified_base (417)..(417): a, c, t, g, unknown or other
  misc_feature (417)..(417): n is a, c, g, or t
  modified_base (430)..(430): a, c, t, g, unknown or other
  misc_feature (430)..(430): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccctgtctttgttccaggggaaanagccaccctctcctgcagggccagtcagggttnttaacagtctacttagcctaggtaaccaaacgaaaacctggccaggctcccaggctcatcatctatgacgcatcgaacagggccagtggcacgtccccaaggccctagggttcaggtcggacagggttcggtccgtaggggacagtacttcaactctcaccatcagcagcctgacctgacgtntttgactattacnctgtcagcagcgtggacgacgacgcaccgtctacggtttcgggcggtaacgggaccgaagggacggaacgtaacaacggaaacgaaccgtgtggactcggaccctaccgtatctcgttcctctactcccttacccactcg

SEQ ID NO: 355241 - DNA, 515 bp, Homo sapiens
  misc_feature: GZ8MTXP02FNOG7.45.87.H10.1.454.CMB.2.raw
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgttccaggggaaagagccaccctctcctgcagggccagtcagggtgttaacagctacttagcctggtaccaacaaaacctggccaggctcccaggctcatcatctatgacgcatcgaacagggccactggcatcccagccaggtcagtgcagtgggtcctgggacagcttcacttctcactatcagcagcctggaccctgaggtatttgcctatttactactgtcagcagcgtggcgacgagcgctctacgttcggcggacgggacgaagggtggagatacgaaacgacgtgtggctcgcaccatcgtgtctcactcctcccgctac

SEQ ID NO: 355242 - DNA, 519 bp, Homo sapiens
  misc_feature: GZ8MTXP02HP6OP.45.87.H10.1.454.CMB.2.raw
  modified_base (203)..(203): a, c, t, g, unknown or other
  misc_feature (203)..(203): n is a, c, g, or t
  modified_base (363)..(363): a, c, t, g, unknown or other
  misc_feature (363)..(363): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagggtgttaacagctacttagcctggtaccaacaaaacctggccaggctcccaggctcatcatctatgacgcatcgaacagggccactggcatcccagccaggttcagtgcaggtggtcctggggacagacttnactctcaccatcagcagcctgaccctgaggtatttgctatttactactgtctagcagcgtggcgacgagcgctcacgtttcggcggacgggccgaaggtggagatacgaaacgaactgtaggctcgacaccgatctgtcttcacttcctccgctac

SEQ ID NO: 355243 - DNA, 566 bp, Homo sapiens
  misc_feature: GZ8MTXP02GC4OJ.45.87.H10.1.454.CMB.2.raw
  modified_base (398)..(398): a, c, t, g, unknown or other
  misc_feature (398)..(398): n is a, c, g, or t
  modified_base (436)..(436): a, c, t, g, unknown or other
  misc_feature (436)..(436): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaagagccaccctctcctgcagggccagtcagggtgttaacagctacttagcctggtaccaacaaaacctggccaggctcccaggctcatcatcatgacgcatcgaacaggggccagtcggcatccccagcccaggttcagtgcagtgggtctgggacagacttcactctcaccatcagccagcctcggaccctgaggtntttcgcctatttactactgtcagcagcggtggcgacgngcgtctcgtaccgtttcggacgggacggaccgaagggtacggacgtacgtaacgaaaacggtaacgtggtacggcgtacgacccactaatcgtcggttacttactacgtttcctaccccggaccttaccg

SEQ ID NO: 355244 - DNA, 520 bp, Homo sapiens
  misc_feature: GZ8MTXP02FTY8W.45.87.H10.1.454.CMB.2.raw
  modified_base (234)..(234): a, c, t, g, unknown or other
  misc_feature (234)..(234): n is a, c, g, or t
  modified_base (240)..(240): a, c, t, g, unknown or other
  misc_feature (240)..(240): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgttccaggggaaagagccaccctctcctgcagggccagtcagggtnttaacngctacttagcctggtaccaacaaaacctggccaggctcccaggctcatcatctatgacgcatcgaacagggccatggcatcccagcccaggttcagtgcaggtggcctgggacagacttcactctcaccatcagcagcctggaccctgacggtatttcgacctatttacacttgtcagcagtcgtggacgacgagcgctctacgttcggcggtagggaccagggtgagatacgaacgactggacgctcgcacatcgtcgtcttcacttcctacccgctac

SEQ ID NO: 355245 - DNA, 545 bp, Homo sapiens
  misc_feature: GZ8MTXP02JWKQP.45.87.H10.1.454.CMB.2.raw
  modified_base (311)..(311): a, c, t, g, unknown or other
  misc_feature (311)..(311): n is a, c, g, or t
  modified_base (380)..(380): a, c, t, g, unknown or other
  misc_feature (380)..(380): n is a, c, g, or t
  modified_base (520)..(520): a, c, t, g, unknown or other
  misc_feature (520)..(520): n is a, c, g, or t
tcagacgcgatcgacacgaccggtgctcgatttagcagtactgcgttgggtttgggggaggaactgctcagttaggacccagagggaaccatggaagccccagctcagcttctcttcctcctgtccactctggctcccagataccaccggagaaattgtgttgacacagtctccagccaccctgtctttgtttccaggggaaagagccaccctctcctgcagggccagtcagggtgttaacagctacttagcctggtaaccaacaaaacctggccaggctcccaggctcatcatctatgacgcatcgaacngggccacgtggcactcccagccaggttcagtgcaggtggtcctggggacagtagttcactctcaccgtnagcagccgtggacgcctgtactgtattttgcttagtttacttcgtgtcagcagtccgttccgccacgtccgctctacggttccggggcgggggtaccaggggtcggagagtggacggacgaacgtggcgtcgtcgcacgntcgtgtctcacttccgtccgctacg

SEQ ID NO: 355246 - DNA, 551 bp, Homo sapiens
  misc_feature: GZ8MTXP02H14BV.45.87.H10.1.454.CMB.2.raw
  modified_base (203)..(203): a, c, t, g, unknown or other
  misc_feature (203)..(203): n is a, c, g, or t
  modified_base (235)..(235): a, c, t, g, unknown or other
  misc_feature (235)..(235): n is a, c, g, or t
  modified_base (282)..(282): a, c, t, g, unknown or other
  misc_feature (282)..(282): n is a, c, g, or t
  modified_base (376)..(376): a, c, t, g, unknown or other
  misc_feature (376)..(376): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagggtnttaacagctacttagcctggtaccaacaaaactgccaggctccagcnatcatctatgacgcatcgaacaggggcccaacgtggccatccccagccctaggttcagtggcaggtggtctgggacagacttcacttctcaccntcagcagctcgccctgagtatttgactatttactactgtcagtcagcgtcggcgacgagccgctcgtacgttcggacggtagggaccgtaagggtagaacgaagttacgaaaacgtacgtaggtacgacgtgaccaaccagttctacggttctactactttcctcccgacttacg

SEQ ID NO: 355247 - DNA, 580 bp, Homo sapiens
  misc_feature: GZ8MTXP02HX19Z.45.87.H10.1.454.CMB.2.raw
  modified_base (304)..(304): a, c, t, g, unknown or other
  misc_feature (304)..(304): n is a, c, g, or t
  modified_base (348)..(348): a, c, t, g, unknown or other
  misc_feature (348)..(348): n is a, c, g, or t
  modified_base (370)..(370): a, c, t, g, unknown or other
  misc_feature (370)..(370): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctaggtaccaaacaaaacctggaccaggcctcccaggctcatcatctatgacnatcgaacagggccacgtggcactcccagcccaggttcagtcggnaggtggccgtgggacagtactnactctcacatcagcacgcctacgaccctgacgtatttcgcctatttacagtgtcagtcacgcgtcggcgaccgtagcgactcgtacgttcgggacggtacgggaccgtaaggtggaacgaacgtaccgaaaacgtaacgtggtacggtactacggccaacctacgtccgttacggttccttttacactttaccccgtcccgtaccctacg

SEQ ID NO: 355248 - DNA, 518 bp, Homo sapiens
  misc_feature: GZ8MTXP02FOHCA.45.87.H10.1.454.CMB.2.raw
  modified_base (354)..(354): a, c, t, g, unknown or other
  misc_feature (354)..(354): n is a, c, g, or t
  modified_base (414)..(414): a, c, t, g, unknown or other
  misc_feature (414)..(414): n is a, c, g, or t
  modified_base (498)..(498): a, c, t, g, unknown or other
  misc_feature (498)..(498): n is a, c, g, or t
tcagacgcgatcgacacgaccggtgctcgatttagcagtactgcgttgggtttggggaggaactgctcagttaggacccagagggaaccatggaagccccagctcagcttctcttcctcctggcactctggctcccagataccaccggagaaattgtgttgacacagtctccagccaccctgtctttgtttccaggggtaagagccacctctcctgcagggccagtcaggttgttaacagctacttagcctggtaccacaaaccctggccaggctcccaggctcatcatctatgacgcatcgacaggtccactggcatccccagcccaggttcagtggcagtggtcctgggacngacttcactctcacccatcagcagcctggaccctgaggatttgccatttactactgtcancagcgtgtcgacctacgcgcgctctacgtcggtacggactacgtaggactagacgtaacaaactaacgtacgacgtcgcacacnctctctctctctacctcctc

SEQ ID NO: 355249 - DNA, 544 bp, Homo sapiens
  misc_feature: GZ8MTXP02FLJ2T.45.87.H10.1.454.CMB.2.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagggtgttaacagctacttagcctggtaccaacaaaacctggccaggctcccaggctcatcatctatgacgcatcgaacngggccactggcatcccagccaggttcagtgcagtggtcctggacagactcacttctcaccatcagcagcctcggaccctgaggtatttgcctaatttactaccttgtacagccgtagcggtggccgaccgagccgactctacgtttcgggcggagggtaccgaagggtacggagaacgtacgaaaacgtaacgtcggtggactcgaccacattctgtcttcattcctcccgctac

SEQ ID NO: 355250 - DNA, 586 bp, Homo sapiens
  misc_feature: GZ8MTXP02HWXZF.45.87.H10.1.454.CMB.2.raw
  modified_base (440)..(440): a, c, t, g, unknown or other
  misc_feature (440)..(440): n is a, c, g, or t
  modified_base (449)..(449): a, c, t, g, unknown or other
  misc_feature (449)..(449): n is a, c, g, or t
  modified_base (466)..(466): a, c, t, g, unknown or other
  misc_feature (466)..(466): n is a, c, g, or t
  modified_base (582)..(582): a, c, t, g, unknown or other
  misc_feature (582)..(582): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagcctaggtaaccaacaaaacctggccaggctcccaggctcatcatctatgacgcatacgaacagggccagtggaccatcccagcctaggttcaggtggcaggtcggtcctggggacagtacttcactctccacctatcgacgacacgccgttacgggaccctaggaggttactttcgacccttatttaacncttgtcagnagtcgtaggcaccggancccgtactaccgtagttccgggacgggaacggaccgtaagggacggaagacttaacggaaaacgtacgtgtacggctacggaccactatcgttacgtacttcaatccctttacccnctac

SEQ ID NO: 355251 - DNA, 683 bp, Homo sapiens
  misc_feature: GZ8MTXP02JC2OS.45.87.H10.1.454.CMB.2.raw
  modified_base (202)..(202): a, c, t, g, unknown or other
  misc_feature (202)..(202): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgttccaggggaaanagccaccctctcctgcagggccagtcagggtgttaacagctacttagcctaggtaaccaaacaaaacctggaccaggcctcccaggctcatcatctatgacgcatcgaacagggccacgtggcactcccagccctaggttcaggtggcgtaggtcgggtcgtaggggacagtacttcacttctcacatcagcacgccgtcggaccctgaaggttactttcgaccttaagttttacctacgttcgtactacgaccgtaggtccggtcggacccggtaaccggcgtcccgtcgttaccgtaccgggtttaccggggaccgggggtaacggggtaacccggaaagggggttacgggaaacgtaacgttaaaccgaaaaaccggtacggtttcgggtacggtaccgtttacggaaccctaaccgttagttcccgttacggttaccctttacctacgtttccccgtttacccccggactttaaccg

SEQ ID NO: 355252 - DNA, 524 bp, Homo sapiens
  misc_feature: GZ8MTXP02FWI8X.45.87.H10.1.454.CMB.2.raw
  modified_base (234)..(234): a, c, t, g, unknown or other
  misc_feature (234)..(234): n is a, c, g, or t
  modified_base (478)..(478): a, c, t, g, unknown or other
  misc_feature (478)..(478): n is a, c, g, or t
  modified_base (495)..(495): a, c, t, g, unknown or other
  misc_feature (495)..(495): n is a, c, g, or t
  modified_base (499)..(499): a, c, t, g, unknown or other
  misc_feature (499)..(499): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcaatctggctcccagataccaccggagaaattgtgttgacacagtctccagccaccctgtctttgttccaggggaaagagccaccctctcctgcagggccagtcagggtnttaacagctacttagcctggtaccaacaaaacctggccaggctcccaggctcatcatctatgacgcatcgaacaggggccactggcatcccagcccaggttcagtggcaggtgggctgggacagacttcactctcaccatcagcacgcctggaccctgaggtatttcgctatttactactgtcagccagtccgtccgccacgccgctacgacgtttccggggcgggggaccaggggtgagtagngagacgactggcgcacncacntctcgtctctctcctccactactcg

SEQ ID NO: 355253 - DNA, 673 bp, Homo sapiens
  misc_feature: GZ8MTXP02JAU0A.45.87.H10.1.454.CMB.2.raw
  modified_base (204)..(204): a, c, t, g, unknown or other
  misc_feature (204)..(204): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccgaggggaaangccaccctctcctgcagggccagtcgagggtgttaacagctacttagcctaggtaaccaacaaaacctggaccaggctcccaggctcatcatctatgacgcatcgaacagggccactggcactcccagcccaggttcaggtggcaggtggtccgtgggacagtacttcactctcaccatccgagccagtcccgtacggacccgtagtacggttacgttttacggtacccttaattttaccttaccttcgttaccagacgtacggtcggtacgggaccggaacccggacggcccgtaccgttaccgtaacccggtttccgggaccggggaacggggtaacccgtaaggggttacgggaaagacgttaaccgaaaacggtaaccgtagggtacggtacgttaccggacctaaccgtacgttcgtaccggtttccgtttaccaactttccccgttaccccgtaccttaaccg

SEQ ID NO: 355254 - DNA, 548 bp, Homo sapiens
  misc_feature: GZ8MTXP02HTGNX.45.87.H10.1.454.CMB.2.raw
  modified_base (400)..(400): a, c, t, g, unknown or other
  misc_feature (400)..(400): n is a, c, g, or t
  modified_base (513)..(513): a, c, t, g, unknown or other
  misc_feature (513)..(513): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcaggggtgttaacagctacttagcctggtaccaaacaaaacctggccaggctcccaggctcatcatcatgacgcatcgaacaggggccactggcatccccagcccaggttcagtgcaggtggtctggggacagcttcacttctcacctatcagcagtctcggacctgaggtnttttcgccttatttactactgtcagcagcgtggcgcgagcgactcacgttcggcggtagggaccgaagggtcgaagtactacgaaaacgaacgtgacggtcgtacgcgaaccncgttctcgtccttcacttcctttcccggccttacg

SEQ ID NO: 355255 - DNA, 539 bp, Homo sapiens
  misc_feature: GZ8MTXP02F7TJ7.45.87.H10.1.454.CMB.2.raw
  modified_base (235)..(235): a, c, t, g, unknown or other
  misc_feature (235)..(235): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtnttaacagctacttagcctggtaccaacaaaacctggaccaggctcccaggctcatcatctatgacgcatcgaacagggccactggcactcccagcccaggttcagtggcaggtggtcctgggacagacttcactctcaccatcagcagcctggaccctgagtatttgacctatttactactgtcagcagcgtggacgaccgagcgctcgacgttcggcggagggaccagggtggagacgtacgaaaacggactggacgcgtcgaccactataaccgttgtccttacacttccctcccgctaacg

SEQ ID NO: 355256 - DNA, 527 bp, Homo sapiens
  misc_feature: GZ8MTXP02FJVTR.45.87.H10.1.454.CMB.2.raw
  modified_base (240)..(240): a, c, t, g, unknown or other
  misc_feature (240)..(240): n is a, c, g, or t
  modified_base (370)..(370): a, c, t, g, unknown or other
  misc_feature (370)..(370): n is a, c, g, or t
  modified_base (392)..(392): a, c, t, g, unknown or other
  misc_feature (392)..(392): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgttccaggggaaagagccaccctctcctgcagggccagtcagggtgttaacngctacttagcctggtaccaacaaaacctggccaggctcccaggctcatcatctatgacgcatcgaacagggccactggcatcccagccaggttcagtgcaggtggtcctgggacagacttcactctcacntcagcagcctgaccctgaggtntttgcatttacactgtcagcagcgtggcgaccgagccgctctaccgtttcgggacggtaggggaccgaagggtggagaagtacaaaacggaactggtaggctacgccacatcgtgtcttcactcctacccgctac

SEQ ID NO: 355257 - DNA, 678 bp, Homo sapiens
  misc_feature: GZ8MTXP02GQGE8.45.87.H10.1.454.CMB.2.raw
  modified_base (314)..(314): a, c, t, g, unknown or other
  misc_feature (314)..(314): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgttccaggggaaagagccaccctctcctgcagggccagtcagggtgttaacagctacttagcctaggtaaccaaacaaaacctggccaggcctcccaggctcatcatctatcgacgcaatcgaacngggcccacgtggacactccccgagcccgaggttcaggtggaccgtagggttgggtcccgtaggggaacctaggtacctttacaaccttctacccaacctactaccgacgccgaacgtcccgttacgggacccgttggtaaacggttattttcgacctttaacttttaaccgtacgttgtacgacgtactagggccggttcggaccgggaccgaggcccgtccgtaccgtaccgtttccggggacggggaacgggtaacccgaagggtaggaacgtaacgtaacgaaaacggtaacgtcgggttacggcctacggacctaactacgttcgtacgtttccgtacctactccgttccccgtactacg

SEQ ID NO: 355258 - DNA, 578 bp, Homo sapiens
  misc_feature: GZ8MTXP02FIYK1.45.87.H10.1.454.CMB.2.raw
  modified_base (289)..(289): a, c, t, g, unknown or other
  misc_feature (289)..(289): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgttccaggggaaagagccaccctctcctgcagggccagtcagggtgttaacagtctacttagcctggtaaccaaacaaaacctggcaggctccaggctaancatctatgacgcatacgaacagggccacgtggcactcccagccgaggttcaggttcggcgttggtcggggttactacggggacaggtacttcactcctacaccatcagcacgcctacggaccctgaggtatttcgacttattactatgtcacgcagcgtcgggacgacgacgcgctcgtacgttcgggacgggacggacgaaggtggaagtacgtaacgaaaacgtacgtggtacggctacgacctacacttcgtaacgtcttacacttcccgttacccactacttacg

SEQ ID NO: 355259 - DNA, 722 bp, Homo sapiens
  misc_feature: GZ8MTXP02IXYFJ.45.87.H10.1.454.CMB.2.raw
  modified_base (203)..(203): a, c, t, g, unknown or other
  misc_feature (203)..(203): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgttccgaggggaaanagccaccctctcctgcagggccagtcgagggtattaacagctacttagcctaggtaaccaaacaaaaccgtggaccaggcctcccgaggctcatcatctatgacgcatacgaacgagggcccaagtggaccactccccgagcccgtaggttccaggtcggaccgtagggttcggggtcccgtaggggaactacggtacctttccaacttcctacaccctaataccgaagccgaacgtcccgtacggtaacccgtaggtaacggttacgttttacgtacccttaattttactaacgttcgtaccgaagacgacggtcggtacggaccggaccggtacgcccgtccgttaccgtaaccggtttccggggaccggggtaacggggaaaccgtaaggggtaaggaaacgaacgttaaaccgaaaacggtaaacgtcgggtacggaccgttacgaccgtaacctaacgttccggttacgtttaccgttaccttaccttaccccggtttacccgtcctttaaccg

SEQ ID NO: 355260 - DNA, 603 bp, Homo sapiens
  misc_feature: GZ8MTXP02GCQCH.45.87.H10.1.454.CMB.2.raw
  modified_base (235)..(235): a, c, t, g, unknown or other
  misc_feature (235)..(235): n is a, c, g, or t
  modified_base (292)..(292): a, c, t, g, unknown or other
  misc_feature (292)..(292): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtnttaacagctacttagcctaggtaccaacaaaacctggaccaggcctcccgagctaancatctatgacgcatacgaacaggccacgtggcactcccagcctaggttcaggtcggcgtggtcgggtctcggggactagtacttcacctctacaccatcagcacgcctgaccctagagttatttcgaccttatttacgtactcgtcacgtcgagcgtacggaccgaccggacgccgtccttacgtaccggttccgggacggggtacgggaccgtaaggggtgaagtacgtaacgaaaacggtactggacgtccgtacaccgtactattcgttaacgttccttaccgtaccttccctacccgtacctactcg

SEQ ID NO: 355261 - DNA, 634 bp, Homo sapiens
  misc_feature: GZ8MTXP02IYL0H.45.87.H10.1.454.CMB.2.raw
  modified_base (211)..(211): a, c, t, g, unknown or other
  misc_feature (211)..(211): n is a, c, g, or t
  modified_base (241)..(241): a, c, t, g, unknown or other
  misc_feature (241)..(241): n is a, c, g, or t
tcagacgcgatcgacacgaccggtgctcgatttagcagtactgcgttgggtttgggggccctggggaggaactgctcagttagggcccagagggaaccatggaagcccccagctcagcttctcttcctcctggcactctggctcccagataccaccggagaaattgtgttgacacagtctccagccaccctgtctttgttccaggggaaangccacctctcctgcagggccagtcagggtnttaacagctacttagcctggtaaccaaacaaaacctggccaggcctcccaggctcatcatctatgacgcatcgaacgacgggccacgtggacactccccagcctaggttcaggtcggactaggtcggggtctggggactagtaccttcacttcctacacctatccagccacgccgtacggaccctgacggtactttcgactactttactacttcgtcacgctacggtcggtacggccgtaccggagccgaccgtccgtacggtttcggggacggtacggggtaaccgaaggggtacggaacggacgttaaacgaaaccgtaaggtcggtcggacgttcggacctaaccgtacgttcgttacggttacctttccgtactttcccgtttaccccg

SEQ ID NO: 355262 - DNA, 579 bp, Homo sapiens
  misc_feature: GZ8MTXP02H3KVB.45.87.H10.1.454.CMB.2.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
  modified_base (363)..(363): a, c, t, g, unknown or other
  misc_feature (363)..(363): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaangccacctctcctgcagggccagtcagggtgttaacagctacttagcctggtaccaaacaaaacctggaccaggcctcccgaggctcatcatctatgacgnattgaacagggccagtggacactccccagccgtaggttccaggtggcgaggtgggtcccnggggaccaggacttcactctccacgatcagccagtcctcgaccctgaggtacttttcgacctaatttacgtactggtacaacgtcgacggacgtggaccgtaccggagccgacgtcgtacgttcgggcggacgggaaccgaagggtcggaagaacgtacgaaaacgtacgtggacggctagacctacgatctcgtacttcacgtcctcccgactac

SEQ ID NO: 355263 - DNA, 534 bp, Homo sapiens
  misc_feature: GZ8MTXP02FJZCH.45.87.H10.1.454.CMB.2.raw
  modified_base (203)..(203): a, c, t, g, unknown or other
  misc_feature (203)..(203): n is a, c, g, or t
  modified_base (479)..(479): a, c, t, g, unknown or other
  misc_feature (479)..(479): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaanagccaccctctcctgcagggccagtcagggtgttaacagctacttagcctggtaccaacaaaacctggccaggctcccaggctcatcatctatgacgcatcgaacaggggccactggcactccccagcccaggttcaggtgcaggtgggtctgggacagtacttcacttctcaccatcagcagcctcgaccctgaggtatttgctatttacactgtctagcagcgtcggacgaccgagcgcctcacgtttcggcggacgggaccgaaggtggaganaccgaaaacgactggtggctcgacactactcgtcgtctctacttcctcccgctac

SEQ ID NO: 355264 - DNA, 704 bp, Homo sapiens
  misc_feature: GZ8MTXP02FSTWG.45.87.H10.1.454.CMB.2.raw
  modified_base (234)..(234): a, c, t, g, unknown or other
  misc_feature (234)..(234): n is a, c, g, or t
  modified_base (304)..(304): a, c, t, g, unknown or other
  misc_feature (304)..(304): n is a, c, g, or t
  modified_base (384)..(384): a, c, t, g, unknown or other
  misc_feature (384)..(384): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgttccgagggaaagagccaccctctcctgcagggccagtcagggtnttaacagtctacttagcctagtaccaacaaaactgccaggctccagctcatcatcatcgagcatcgaacngggccagtgacactcccgagccaggttcaggtcggctagggtcggtccgtagggacctaggtacctttcgaaccgtttcnccgactactcgacgccgacgtacccgtacggtacccgttaggacggttactttacgacccgttaacttttaccgtaccgttacggttacgaacgtaccgtaaggtccggttaccgggaccggtaccggaccgtccgtaccggttaccgtttacccgggtttacgggggacccggggtacggggtaaacccggtaagggttacgggaaccgtaaagttaaccgaaaacggtaccggttggtaaacgggtctaccggtacctaacggtacctcgtttacgttaccgttacgtaccctttccgttaccccgtaccgttaaccg

SEQ ID NO: 355265 - DNA, 518 bp, Homo sapiens
  misc_feature: GZ8MTXP02GDFBT.45.87.H10.1.454.CMB.2.raw
  modified_base (235)..(235): a, c, t, g, unknown or other
  misc_feature (235)..(235): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtnttaacagctacttagcctggtaccaacaaaacctgccaggctcccaggctcatcatctatgacgcatcgaaacagggccactggacatccccagcccaggttcagtgcagtggtctgggacagacttcactctcaccatcagcagcctgaccctgagtatttgcctatttactactgtcagcagcgtcggcgaccgagccgctcacgttggcggtacgggaccaaggttgagatacgaaaacgaactgtagctcgacacatcgtgtctcactcctcccgctac

SEQ ID NO: 355266 - DNA, 546 bp, Homo sapiens
  misc_feature: GZ8MTXP02HIWGU.45.87.H10.1.454.CMB.2.raw
  modified_base (437)..(437): a, c, t, g, unknown or other
  misc_feature (437)..(437): n is a, c, g, or t
tcagacgcgatcgacacgaccggtgctcgatttagcagtactgcgttgggtttgggggaggaactgctcagttaggacccagagggaaccatggaagccccagctcagcttctcttcctcctggcactctggctcccagataccaccggagaaattgtgttgacacagtctccagccaccctgtctttgtttccaggggaaagagccaccctctcctgcagggccagtcagggtgttaacagctacttagctggtaccaacaaaactggccaggctcccaggctcatcatctatgacgcatcgaacagggccactggcatcccagcccaggttcaggtgcaggtggtcctggggacagacttcactctcaacatcagctagcctcggaccctgagtatttgacctattactactgtacagcagcgtggaccgacggngccgcgttacaccgttcgggcggacgggacgaagggtggagacgtaacgaaaacggacgttaggcgcgtcgaccactacgtccgttgtcttcgactccgttaccgctac

SEQ ID NO: 355267 - DNA, 470 bp, Homo sapiens
  misc_feature: GZ8MTXP01D9GHS.11.39.D06.1.454.CMB.2.raw
  modified_base (249)..(249): a, c, t, g, unknown or other
  misc_feature (249)..(249): n is a, c, g, or t
  modified_base (378)..(378): a, c, t, g, unknown or other
  misc_feature (378)..(378): n is a, c, g, or t
  modified_base (467)..(470): a, c, t, g, unknown or other
  misc_feature (467)..(470): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattacngtgcgagggagtcctattacgcagctggctactacgttgacttctggggccaggggaccctggtcaccgtctcctcagcctccaccaaggcccatcggtcccttccccctggccaccctccctccaagngcacctctgggggcacagcgccctgggctgcctggtcaaagggctacttccgtatctctcgctggagcggggctggcaaggcgcaatgnnnn

SEQ ID NO: 355268 - DNA, 471 bp, Homo sapiens
  misc_feature: GZ8MTXP01AVYD2.11.39.D06.1.454.CMB.2.raw
  modified_base (374)..(374): a, c, t, g, unknown or other
  misc_feature (374)..(374): n is a, c, g, or t
  modified_base (464)..(471): a, c, t, g, unknown or other
  misc_feature (464)..(471): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaacccaattctccctgaggttgacctctgtgaccactgcggacacggccgtctattactgtgcgaggagtcctattacgcagctggctactacgttgacttctggggccaggggaccctggtcaccgtctcctcagcctccaccaaggcccatcggtcctccccctggcaccctcctccaagngcacctctgggggcacagcggccctgggctgcctggtcaagggctactccgtatctctcgctgggagcggggctgggcaaggcgcatagnnnnnnnn

SEQ ID NO: 355269 - DNA, 533 bp, Homo sapiens
  misc_feature: GZ8MTXP01APTVB.11.39.D06.1.454.CMB.2.raw
  modified_base (216)..(216): a, c, t, g, unknown or other
  misc_feature (216)..(216): n is a, c, g, or t
  modified_base (465)..(465): a, c, t, g, unknown or other
  misc_feature (465)..(465): n is a, c, g, or t
  modified_base (513)..(533): a, c, t, g, unknown or other
  misc_feature (513)..(533): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctcctcaagagtcgagtcaccatatcattagacacttccaagaaccaattctccctgaggttgacctntgtgaccatgcggacacggcctctattactgtgcgagggtacgtcctatacgcagctggctactacgttgacttcgtcggggccgacggggaccctggtccaccgtctccctcacgccctccaccgaacggccactccggtcccctccccctggcccacccctcctaacccaagcgccaccgtcggtcgggggcacgcgcccggccctgggctcgcgtggtacgaacggtcctacttccgtatccctcncgtctaggggacggccggggtctcgggacgaacggggcaccgaagtgnnnnnnnnnnnnnnnnnnnnn

SEQ ID NO: 355270 - DNA, 485 bp, Homo sapiens
  misc_feature: GZ8MTXP01EQCKT.11.39.D06.1.454.CMB.2.raw
  modified_base (473)..(473): a, c, t, g, unknown or other
  misc_feature (473)..(473): n is a, c, g, or t
  modified_base (475)..(485): a, c, t, g, unknown or other
  misc_feature (475)..(485): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaaagaaccaattctccctgaggttgacctctgtgaccactgcggacacggccgtctattactgtgcgaggagtcctattacgcagctggctactacgttgacttctggggccaggggaccctggtcaccgtctcctcacgcctccacacggccatcggtcctcccctggccaccctccctccaagcgcaccctcgtcgggggccacgacgccggccccgtgggctgccctggtcaaaggctactccgtatctctcgctggacgcggggctgggcaaggcgcgaangnnnnnnnnnnn

SEQ ID NO: 355271 - DNA, 597 bp, Homo sapiens
  misc_feature: GZ8MTXP01AP2UJ.11.39.D06.1.454.CMB.2.raw
  modified_base (363)..(363): a, c, t, g, unknown or other
  misc_feature (363)..(363): n is a, c, g, or t
  modified_base (386)..(386): a, c, t, g, unknown or other
  misc_feature (386)..(386): n is a, c, g, or t
  modified_base (575)..(576): a, c, t, g, unknown or other
  misc_feature (575)..(576): n is a, c, g, or t
  modified_base (578)..(581): a, c, t, g, unknown or other
  misc_feature (578)..(581): n is a, c, g, or t
  modified_base (583)..(585): a, c, t, g, unknown or other
  misc_feature (583)..(585): n is a, c, g, or t
  modified_base (588)..(597): a, c, t, g, unknown or other
  misc_feature (588)..(597): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtcccctccctcaagagtcgagtcaccatatcattagacacttccaagaaccaattcctccctgaggttgacctctgtgaccactgcggacacggcctctattactgtgcgagggagtctattacgcagctgactactacgttgacttctggggccaggggaccctggtcaccgtctcctcacgcctccaccagggcccagtccggtcccttcccccgnggccacccctccctacccaagcnccacctcgtcgggggcacgacgccgggcccctggggccttcggcccgttcgggtccgaaacgggtaccttaaccgtttcccggttaacttccctcgttcccgggtaccttacgggggacggggtccgggggccgttacgggggacccgtaaacgggggccggtacccgtaaacgggtacggtcgcgcgnngnnnngnnngcnnnnnnnnnn

SEQ ID NO: 355272 - DNA, 513 bp, Homo sapiens
  misc_feature: GZ8MTXP01A5XT6.11.39.D06.1.454.CMB.2.raw
  modified_base (244)..(244): a, c, t, g, unknown or other
  misc_feature (244)..(244): n is a, c, g, or t
  modified_base (251)..(251): a, c, t, g, unknown or other
  misc_feature (251)..(251): n is a, c, g, or t
  modified_base (504)..(513): a, c, t, g, unknown or other
  misc_feature (504)..(513): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtcccctccctcaagagtcgagtcaccatatcattagacacttccaaagaaccaattctccctgaggttgacctctgtgaccactgcggacacggccgtntattacngtgcgagggagtcctatacgcagctggctactacgttgacttcgtggggccaggggaccctggtcaccgtctcctcagcctccaccgaacgggcccatccggtccccttcccccgtggcccaccctccctacccaagcgccacctcgtcgggggccacgacggcccgggccctggggctcgccgtggtccaaagggtaccttacttcccgtatcctctcgctggggacgtcggggctgggcaaggcgcagtgnnnnnnnnnn

SEQ ID NO: 355273 - DNA, 491 bp, Homo sapiens
  misc_feature: GZ8MTXP01DU7J1.11.39.D06.1.454.CMB.2.raw
  modified_base (483)..(483): a, c, t, g, unknown or other
  misc_feature (483)..(483): n is a, c, g, or t
  modified_base (486)..(491): a, c, t, g, unknown or other
  misc_feature (486)..(491): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccatgcggacacggccgtctattactgtgcgagggagtcctattacgcagctggctactacgttgacttctggggccaggggaccctggtcaccgtctcctcagcctccaccagggcccatccggtcccttccccctggccacccctccctacccaagcgcaccctcgtcgggggcacagcgggccctggggctcggccctggtccaaagggcctacttccgtatctctcgcctgggacgcggggctgggccaaggcgcanagnnnnnn

SEQ ID NO: 355274 - DNA, 532 bp, Homo sapiens
  misc_feature: GZ8MTXP01B2L4X.11.39.D06.1.454.CMB.2.raw
  modified_base (250)..(250): a, c, t, g, unknown or other
  misc_feature (250)..(250): n is a, c, g, or t
  modified_base (327)..(327): a, c, t, g, unknown or other
  misc_feature (327)..(327): n is a, c, g, or t
  modified_base (520)..(532): a, c, t, g, unknown or other
  misc_feature (520)..(532): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtcccctccctcaagagtcgagtcaccatatcattagacacttccaagaaccaattctccctgaggttgacctctgtgaccactgcggacacggccgtctattacngtgcgagggacgtctattacgcagctggctactacgttgacttcgtggggccgaggggccctggtccaccgtctccncacgccctccaccgaacgggcccacgtccggtccccttcccccgtcggccacccctcctaaccaagcgccaccctcggtcgggggcacgacggcccggcccgtgggccgtcgccgtcggtacgaacggtaccttacgttccgtactcctcgtcgtcggacggggcgggtcgtcggacgaaggccgcgagtagnnnnnnnnnnnnn

SEQ ID NO: 355275 - DNA, 527 bp, Homo sapiens
  misc_feature: GZ8MTXP01A3IFF.11.39.D06.1.454.CMB.2.raw
  modified_base (251)..(251): a, c, t, g, unknown or other
  misc_feature (251)..(251): n is a, c, g, or t
  modified_base (505)..(505): a, c, t, g, unknown or other
  misc_feature (505)..(505): n is a, c, g, or t
  modified_base (511)..(527): a, c, t, g, unknown or other
  misc_feature (511)..(527): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtcccctccctcaagagtcgagtcaccatatcattagacacttccaagaaccaattctcccctgaggttgacctctgtgaccactgcggacacggccgtctattacngtgcgagggagtcctattacgcagctggctactacgttgacttcgtggggccagggggaccctggtcaccgtctcctcacgccctccaccaacgggccccagtccggtcccccttcccccctggccctaccccgtccctacccgaagcgccacccgtcgtgggggccacgacgcccggcccctggggctcggcctgggtcaaacgggccttacgtccgtatcctctcgctggggacgcggggctgggacaggcncgatgnnnnnnnnnnnnnnnnn

SEQ ID NO: 355276 - DNA, 495 bp, Homo sapiens
  misc_feature: GZ8MTXP01AZWZI.11.39.D06.1.454.CMB.2.raw
  modified_base (242)..(242): a, c, t, g, unknown or other
  misc_feature (242)..(242): n is a, c, g, or t
  modified_base (491)..(495): a, c, t, g, unknown or other
  misc_feature (491)..(495): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtntattactgtgcgagggagtcctattacgcagctggctactacgttgacttcgtggggccacgggggaccctggtcaccgtctcctcacgccctccaccgaacgggcccacgtccggtccccttcccccgtcggccacccctccctacccaacgcgccaccctcgtcgggggcacgacgccggccctgggctgcctggtcaaggctacttccgtatctctcgctgggagcgggctgggcaaggcgcatgnnnnn

SEQ ID NO: 355277 - DNA, 593 bp, Homo sapiens
  misc_feature: GZ8MTXP01DBVJS.11.39.D06.1.454.CMB.2.raw
  modified_base (275)..(275): a, c, t, g, unknown or other
  misc_feature (275)..(275): n is a, c, g, or t
  modified_base (581)..(593): a, c, t, g, unknown or other
  misc_feature (581)..(593): n is a, c, g, or t
tcagcgagagataccacgaccggtgctcgatttagtgacatctcgcagttctttgggagtgtctaatgatatggtgactagactcttgagggaagggactggagtggattgggtacatctatgacggtggaagcaccacctacacgtcccctccctcaagagtcgagtcaccatatcattagacacttccaaagaaccaattcctccctgaggttcgacctctgtcgaccacgtgcggacacggccgtctattactgtgcgagggatctatacgnagctgctactacgttgacttcgtcgggccgacgggggccctggtccacccgttctccctcaccgccctacccaaccgaaccgggtccctacgtccccggttccccccttccccccgtcggacccctaccccctcccgtaacccgaacgccgccctaacccgttcgggacggggaccaccggaccgggcccgggtcccgtcgggcctcggtccgtacggtaacgaacggttacccttaccgttcccgtactccgtccgtccggtcgtggggacggggtcgggtcgtcgggacgaacggcgactaagnnnnnnnnnnnnn

SEQ ID NO: 355278 - DNA, 554 bp, Homo sapiens
  misc_feature: GZ8MTXP01A0KOW.11.39.D06.1.454.CMB.2.raw
  modified_base (536)..(536): a, c, t, g, unknown or other
  misc_feature (536)..(536): n is a, c, g, or t
  modified_base (542)..(554): a, c, t, g, unknown or other
  misc_feature (542)..(554): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtcccctcctcaagagtcgagtcaccatatcattagacacttccaagaaccaattctccctgaggttgacctctgtgaccactgcggacacggccgtctattactgtgcgagggagtcctatacgcagctggctactacgttgacttcgtggggccgaggggacccctgggtccaccggtctcctcacgccctccaccgacgggccccagtccggtccccttccccccgtggcccacccctcccaccctaagcgccaccctcgtcgggggccacgagggcccgggcccgtggggccgtcggcccgtcgggtacgaaacgggtacccttacgtttcccggtacttccgtccttccgtccgttggggacggccggggtctcgggcgaaggccgnagtagnnnnnnnnnnnnn

SEQ ID NO: 355279 - DNA, 530 bp, Homo sapiens
  misc_feature: GZ8MTXP01EZY1C.11.39.D06.1.454.CMB.2.raw
  modified_base (519)..(530): a, c, t, g, unknown or other
  misc_feature (519)..(530): n is a, c, g, or t
tcagcgagagataccacgaccggtgctcgatttagtgacatctcgcagttctttgggagtgtctaatgatatggtgactcgaatcttgagggaagggactggagtggattgggtacatctatgacggtggaagcaccacctacagtcccctccctcaagagtcgagtcaccatatcattagacacttccaagaaccaattctccctgaggttgaccctctgtgaccactgcggacacggccgtctattactgtgcgagggagtcctattacgcagctggctactacgttgacttctggggccagggggacccctggtccaccgtctccctcacgccctccacccaacgggccccatccggtcccctttcccccccgtggcccacccctccctccctaacgcgtccacccgtccgtcggggggccacgagtcgggcccctggggcctggccctgggtcaaacgggcttacgttcccgtatactctcgcctggggacgtcggggctgggcaaggcgcatgnnnnnnnnnnnn

SEQ ID NO: 355280 - DNA, 546 bp, Homo sapiens
  misc_feature: GZ8MTXP01CEKDC.11.39.D06.1.454.CMB.2.raw
  modified_base (252)..(252): a, c, t, g, unknown or other
  misc_feature (252)..(252): n is a, c, g, or t
  modified_base (528)..(528): a, c, t, g, unknown or other
  misc_feature (528)..(528): n is a, c, g, or t
  modified_base (530)..(546): a, c, t, g, unknown or other
  misc_feature (530)..(546): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaaagaaccaattctccctgaggttcgacctctgtgaccactgccggacacggccgtctattacngtgcgagggagtcctattacgcagctggctactacgttgacttcgtggggccgagggggacccctggtccaccgtctcctcacgccctccgaccaacgggcccagtccggtccccttccccccgtggccctacccctccctaacccgaacgcgccaacccgtcgtcgggggccacgacgcccggcccgtgggctcggccgttggacaaagggaccttaccgttccgtatcctctcgcgtggggacggtcggggtcgtcggacgaaggcgactaagngnnnnnnnnnnnnnnnnn

SEQ ID NO: 355281 - DNA, 547 bp, Homo sapiens
  misc_feature: GZ8MTXP01AOGAA.11.39.D06.1.454.CMB.2.raw
  modified_base (220)..(220): a, c, t, g, unknown or other
  misc_feature (220)..(220): n is a, c, g, or t
  modified_base (244)..(244): a, c, t, g, unknown or other
  misc_feature (244)..(244): n is a, c, g, or t
  modified_base (510)..(510): a, c, t, g, unknown or other
  misc_feature (510)..(510): n is a, c, g, or t
  modified_base (531)..(547): a, c, t, g, unknown or other
  misc_feature (531)..(547): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtcccctccctcaagagtcgagtcaccatatcattagacacttccaaagaaccaattcctccctgaggttgacctntgtgaccactgcggacacggcctntattactgtgcgagggactctattcgcagctggctactacgttgtacttcgtcggggccgacgggggacccctggtcacccgtctccctcacgccctcccgaccgaacgggccccagtccggttcccccttcccccgtggcccacccctccctaaccaagcgccacccgtcggtcgggggcacgacggcccggcccgtgggctcgccgtggtcgaaacggtccttacttccgtattcctacgtcgcctaggggcggtccggggtcngggaccaagggcctagaatgnnnnnnnnnnnnnnnnn

SEQ ID NO: 355282 - DNA, 622 bp, Homo sapiens
  misc_feature: GZ8MTXP01AHM47.11.39.D06.1.454.CMB.2.raw
  modified_base (299)..(299): a, c, t, g, unknown or other
  misc_feature (299)..(299): n is a, c, g, or t
  modified_base (582)..(582): a, c, t, g, unknown or other
  misc_feature (582)..(582): n is a, c, g, or t
  modified_base (585)..(585): a, c, t, g, unknown or other
  misc_feature (585)..(585): n is a, c, g, or t
  modified_base (589)..(589): a, c, t, g, unknown or other
  misc_feature (589)..(589): n is a, c, g, or t
  modified_base (592)..(593): a, c, t, g, unknown or other
  misc_feature (592)..(593): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
  modified_base (601)..(601): a, c, t, g, unknown or other
  misc_feature (601)..(601): n is a, c, g, or t
  modified_base (605)..(605): a, c, t, g, unknown or other
  misc_feature (605)..(605): n is a, c, g, or t
  modified_base (607)..(609): a, c, t, g, unknown or other
  misc_feature (607)..(609): n is a, c, g, or t
  modified_base (611)..(611): a, c, t, g, unknown or other
  misc_feature (611)..(611): n is a, c, g, or t
  modified_base (616)..(617): a, c, t, g, unknown or other
  misc_feature (616)..(617): n is a, c, g, or t
  modified_base (619)..(619): a, c, t, g, unknown or other
  misc_feature (619)..(619): n is a, c, g, or t
  modified_base (621)..(621): a, c, t, g, unknown or other
  misc_feature (621)..(621): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaaagaaccaattcctccctgaggtttcgacctctgtcgaccactgcggacacggccgtctattactgtgcggaggctccgtatacgcagctggctacgtcgttgacttcgngggccgacggggccctggtcaccgtctcctcacgcccctaccgaccgaacggccctagtccggttcccctccccctggaccctaccccgtccctaaaccaaagccgtccaacccgtccggtacgggggcccaacgacgggtccccgggcccgttcgggccgttcggcccgttcgggtacgaaacggtaccttaccgtttacccggaatttcccgtcgttccgtcgtacgggggtacggtcggggaccgtacgggaccgaacggggtcccagtaacgggttaancgngcgncgnngcngngcncgcncnnncncgcgnngngng

SEQ ID NO: 355283 - DNA, 567 bp, Homo sapiens
  misc_feature: GZ8MTXP01AW9PI.11.39.D06.1.454.CMB.2.raw
  modified_base (551)..(567): a, c, t, g, unknown or other
  misc_feature (551)..(567): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtcccctccctcaagagtcgagtcaccatatcattagacacttccaaagaaccaattctccctgaggtttcgacctctgtcgaccatgccggacacggccgtctattctgtgcgagggctctatacgcagctggctactacgttgacttcgtggggccgacggggaccctggtccaccgtctcctcacgccctccaccgacggccctacgtccggtcccccttcccccgtcggccctacccctcccgtaaccgaacgcgacctacccgtcggtcgggggacacggacgcccgggtcccgtggggcctcggccgtcgggtaccgaacgggtacccttaccgttccgtattccgtcgtccgacgtcggggacggtccggggtcgcgggacgaagggcccgataagtgcnnnnnnnnnnnnnnnnn

SEQ ID NO: 355284 - DNA, 472 bp, Homo sapiens
  misc_feature: GZ8MTXP02I90G7.11.39.D06.1.454.CMB.2.raw
  modified_base (372)..(372): a, c, t, g, unknown or other
  misc_feature (372)..(372): n is a, c, g, or t
  modified_base (460)..(472): a, c, t, g, unknown or other
  misc_feature (460)..(472): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgagttgacctctgtgaccactgcggacacggccgtctattactgtgcgagggagtcctattacgcagctggctactacgttgacttctggggccaggggaccctggtcaccgtctcctcagcctccaccaagggcccatcggtctccccctggcaccctcctccaangcacctctgggggcacgagcggccctggggctgcctggtcaggctacttccgtatctctcgctgagcgggctgggcaaggcgcatagnnnnnnnnnnnnn

SEQ ID NO: 355285 - DNA, 476 bp, Homo sapiens
  misc_feature: GZ8MTXP02JG1SC.11.39.D06.1.454.CMB.2.raw
  modified_base (447)..(447): a, c, t, g, unknown or other
  misc_feature (447)..(447): n is a, c, g, or t
  modified_base (465)..(476): a, c, t, g, unknown or other
  misc_feature (465)..(476): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcacgcctccaccagggcccatcggtcccttccccctggccaccctcctccaacgcgcacctctgggggcacagcggccctgggctgcctggtcaggctactccgtatctctcgctgagcgggntcgggcaaggcgcgatgnnnnnnnnnnnn

SEQ ID NO: 355286 - DNA, 471 bp, Homo sapiens
  misc_feature: GZ8MTXP02HPWJR.11.39.D06.1.454.CMB.2.raw
  modified_base (465)..(471): a, c, t, g, unknown or other
  misc_feature (465)..(471): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgagttgacctctgtgaccactgcggacacggccgtctattactgtgcgagggagtcctattacgcagctggctactacgttgacttctggggccaggggaccctggtcaccgtctcctcagcctccaccaacgggccccatccggtcccttccccctggccacccctcctccaagcgcacctctgggggccacagcggccctgggctgcctggtcaaggctacttccgtatctctcgctgagcgggctggcagcgcatgnnnnnnn

SEQ ID NO: 355287 - DNA, 476 bp, Homo sapiens
  misc_feature: GZ8MTXP02I2MAM.11.39.D06.1.454.CMB.2.raw
  modified_base (468)..(476): a, c, t, g, unknown or other
  misc_feature (468)..(476): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctgactactacgttgacttctggggccaggggaccctggtcaccgtctcctcagcctccaccaaggcccatcggtcccttccccctgccaccctcctccaagcgcacctcgtgggggcacagcggccctgggctgcctggtcaaggctacttccgtatctctcgctgacgtcggggcctgggcaaggcgcatagnnnnnnnnn

SEQ ID NO: 355288 - DNA, 520 bp, Homo sapiens
  misc_feature: GZ8MTXP02IIIVY.11.39.D06.1.454.CMB.2.raw
  modified_base (408)..(408): a, c, t, g, unknown or other
  misc_feature (408)..(408): n is a, c, g, or t
  modified_base (499)..(520): a, c, t, g, unknown or other
  misc_feature (499)..(520): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtccaccgtctcctcagcctccaccaagggccccatccggtccccttcccccctggccaccccctccctaccaacgcgccacctcggtcggggaccncgacgcccggccgtcggctcgccgtggtacgaacgtccttacgttccgtactcctctcgtctgacggcggtcgtggacgaggcgacagtgnnnnnnnnnnnnnnnnnnnnnn

SEQ ID NO: 355289 - DNA, 484 bp, Homo sapiens
  misc_feature: GZ8MTXP02HVZQE.11.39.D06.1.454.CMB.2.raw
  modified_base (476)..(484): a, c, t, g, unknown or other
  misc_feature (476)..(484): n is a, c, g, or t
tcagcgagagataccacgaccggtgctcgatttagtgacatctcgcagttctttgggagtgtctaatgatatggtgactcgactcttgagggagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccagggccccatccggtcccttccccctcgccacccctcctcccaagcgcaccctcgtcgggggcacgagccggccctgggcctgcctggtcaaggctacttccgtatctctcgcctgagcggggctcgggcaaggcgcatagnnnnnnnnn

SEQ ID NO: 355290 - DNA, 487 bp, Homo sapiens
  misc_feature: GZ8MTXP02I0YPK.11.39.D06.1.454.CMB.2.raw
  modified_base (477)..(487): a, c, t, g, unknown or other
  misc_feature (477)..(487): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcacgcctccaccaacgggcccatccggtcccttcccccctggccacccctcctcccaagcgccacctcgtcgggggcacgagccggccctggggctcgcctggtcaaggactacgttccgtatctctcgctgagtcggctggcaggcgcatgnnnnnnnnnnn

SEQ ID NO: 355291 - DNA, 473 bp, Homo sapiens
  misc_feature: GZ8MTXP02FZQRT.11.39.D06.1.454.CMB.2.raw
  modified_base (461)..(473): a, c, t, g, unknown or other
  misc_feature (461)..(473): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgaggagtcctattacgcagctggctactacgttgacttctggggccaggggaccctggtcaccgtctcctcagcctccaccaacggcccatcggtcccttccccctgcaccctcctccaagcgcacctctgggggcacagcggccctgggctgcctggtcaaggctacttccgtatctctcgctgagcgggctggcaaggcgcatagnnnnnnnnnnnnn

SEQ ID NO: 355292 - DNA, 464 bp, Homo sapiens
  misc_feature: GZ8MTXP02HEO56.11.39.D06.1.454.CMB.2.raw
  modified_base (365)..(365): a, c, t, g, unknown or other
  misc_feature (365)..(365): n is a, c, g, or t
  modified_base (437)..(437): a, c, t, g, unknown or other
  misc_feature (437)..(437): n is a, c, g, or t
  modified_base (445)..(464): a, c, t, g, unknown or other
  misc_feature (445)..(464): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgaggagtcctatacgcagctgctactacgttgacttctggggccaggggaccctggtcacgtctcctcagcctcaccaaaggccatcgtcctcccctgcaccctctccaagngcactcctgggggcacagcgccctgggcctgcctggcaaggctacttccctatctctcgctgagcggcgcgngagcgcannnnnnnnnnnnnnnnnnnn

SEQ ID NO: 355293 - DNA, 478 bp, Homo sapiens
  misc_feature: GZ8MTXP02FUW73.11.39.D06.1.454.CMB.2.raw
  modified_base (469)..(478): a, c, t, g, unknown or other
  misc_feature (469)..(478): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtcccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaacgggccatcggtccttccccctgccaccctcctcccaagcgcacctctcgggggcacgagcggccctgggctgcctggtcaaggctacttccgtatctctcgctgacgcgggctgggcaaggcgcgatagnnnnnnnnnn

SEQ ID NO: 355294 - DNA, 466 bp, Homo sapiens
  misc_feature: GZ8MTXP02JF6OC.11.39.D06.1.454.CMB.2.raw
  modified_base (461)..(466): a, c, t, g, unknown or other
  misc_feature (461)..(466): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccagggcccatcgtcctccccctggcacctcctccagcgcacctctgggggcacagcggccctgggctgcctggtcaggactacgttccgtagtctctcgctgacgcgggctgggcaaggcgcatagnnnnnn

SEQ ID NO: 355295 - DNA, 502 bp, Homo sapiens
  misc_feature: GZ8MTXP02HKM99.11.39.D06.1.454.CMB.2.raw
  modified_base (258)..(258): a, c, t, g, unknown or other
  misc_feature (258)..(258): n is a, c, g, or t
  modified_base (485)..(502): a, c, t, g, unknown or other
  misc_feature (485)..(502): n is a, c, g, or t
tcagcgagagataccacgaccggtgctcgatttagtgacatctcgcagttctttgggagtgtctaatgatatggtgactcgactcttgagggagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggngtcctattacgcagctggctactacgttgacttcgtggggccaggggaccctggtcaccgtctcctcagcctccaccaacgggccccatccggtccccttcccccgtggccacccctcctccaagcgccacctcgtcgggggccacacgccggccctggggctcgacctggcaaaggcctacttccgtactctctcgcctgacgcgggctgggacaaggcgcatagnnnnnnnnnnnnnnnnnn

SEQ ID NO: 355296 - DNA, 475 bp, Homo sapiens
  misc_feature: GZ8MTXP02JVRU7.11.39.D06.1.454.CMB.2.raw
  modified_base (377)..(377): a, c, t, g, unknown or other
  misc_feature (377)..(377): n is a, c, g, or t
  modified_base (464)..(475): a, c, t, g, unknown or other
  misc_feature (464)..(475): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtcccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaagggcccatcggtccctccccctggcaccctcctccaagngccacctctgggggcacagcggccctggctgcctggtcaaggctacttccgtatctctcgctgagcgggctgggcaaggcgcatagnnnnnnnnnnnn

SEQ ID NO: 355297 - DNA, 474 bp, Homo sapiens
  misc_feature: GZ8MTXP02IO9ER.11.39.D06.1.454.CMB.2.raw
  modified_base (460)..(474): a, c, t, g, unknown or other
  misc_feature (460)..(474): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggtccaggggaccctggtcaccgtctcctcagcctccaccaaggcccatcgtcctccccctggccaccctcctccaagcgcacctctgggggcacagcgcccgtggctgcctgtcaaggctacttccgtatctctcgctgagcgggctgggcaaggcgcatagnnnnnnnnnnnnnnn

SEQ ID NO: 355298 - DNA, 474 bp, Homo sapiens
  misc_feature: GZ8MTXP02FIEIH.11.39.D06.1.454.CMB.2.raw
  modified_base (212)..(212): a, c, t, g, unknown or other
  misc_feature (212)..(212): n is a, c, g, or t
  modified_base (382)..(382): a, c, t, g, unknown or other
  misc_feature (382)..(382): n is a, c, g, or t
  modified_base (449)..(449): a, c, t, g, unknown or other
  misc_feature (449)..(449): n is a, c, g, or t
  modified_base (471)..(474): a, c, t, g, unknown or other
  misc_feature (471)..(474): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttnaccctctgtgaccactgcggacacggccgtctattactgtgcgagggagtcctattacgcagctggctactacgttgacttctggggccaggggaccctggtcaccgtctcctcagcctccaccaacgggcccactcggtcccttcccccctggcacccctcctccaagngccacctctgggggcacagcggccctgggctgcctggtcaaggactacttcccgtatctctcgctgngcgggctgggcaaggcgcatgnnnn

SEQ ID NO: 355299 - DNA, 564 bp, Homo sapiens
  misc_feature: GZ8MTXP02JFK3V.11.39.D06.1.454.CMB.2.raw
  modified_base (121)..(121): a, c, t, g, unknown or other
  misc_feature (121)..(121): n is a, c, g, or t
  modified_base (134)..(134): a, c, t, g, unknown or other
  misc_feature (134)..(134): n is a, c, g, or t
  modified_base (217)..(217): a, c, t, g, unknown or other
  misc_feature (217)..(217): n is a, c, g, or t
  modified_base (242)..(242): a, c, t, g, unknown or other
  misc_feature (242)..(242): n is a, c, g, or t
  modified_base (258)..(258): a, c, t, g, unknown or other
  misc_feature (258)..(258): n is a, c, g, or t
  modified_base (264)..(265): a, c, t, g, unknown or other
  misc_feature (264)..(265): n is a, c, g, or t
  modified_base (377)..(377): a, c, t, g, unknown or other
  misc_feature (377)..(377): n is a, c, g, or t
  modified_base (546)..(564): a, c, t, g, unknown or other
  misc_feature (546)..(564): n is a, c, g, or t
tcagcgagagataccacgaccggtgctcgatttagtgacatctcgcagttcttgggagtgtctaatgatatggtgactcgactcttgagggaagggactggagtggattgggtacatctangacggtggaagcnccacctacagtcccctccctcaagagtcgagtcaccatatcattagacacttccaagaaccaattctccctgaggttgacctntgtgaccactgcggacacggccgtntattactgtgcgaggngcttanncgcagctggctacgtacgttgacgttcgtagggggccctaggggaccctcggtcaccgtctccgtcacgccctaccgacccaagggtccccacgtcccccggtcgtcccccnggtcccaccctaccgccgacgaccgtcctacccggtcgacgggggcaccgcggcccgggcccgtggggcccgttgggacccctaggggtcccaaaagggtccctaacttcccgtatccgtcctcggcgtcgggagcgggggcctaggggccaaagggcgacgcttagcnnnnnnnnnnnnnnnnnnn

SEQ ID NO: 355300 - DNA, 505 bp, Homo sapiens
  misc_feature: GZ8MTXP02H5ZCF.11.39.D06.1.454.CMB.2.raw
  modified_base (489)..(505): a, c, t, g, unknown or other
  misc_feature (489)..(505): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttcgtggggccaggggacccctggtccaccgtctcctcacgccctccaccaacgggccccatccggtcccttcccccctggcccacccctccctcccaacgcgccacctccgtgggggccacgacgccggccctgggctgcctggcaaggctacttccgtatctctcgctgagcgggctgggcgaaggcgacagtacgnnnnnnnnnnnnnnnnn

SEQ ID NO: 355301 - DNA, 480 bp, Homo sapiens
  misc_feature: GZ8MTXP02FL4BH.11.39.D06.1.454.CMB.2.raw
  modified_base (201)..(201): a, c, t, g, unknown or other
  misc_feature (201)..(201): n is a, c, g, or t
  modified_base (368)..(368): a, c, t, g, unknown or other
  misc_feature (368)..(368): n is a, c, g, or t
  modified_base (458)..(458): a, c, t, g, unknown or other
  misc_feature (458)..(458): n is a, c, g, or t
  modified_base (460)..(480): a, c, t, g, unknown or other
  misc_feature (460)..(480): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattcnccctgagttgacctctgtgaccactgcggacacggccgtctattactgtgcgagggagtcctattacgcagctggctactacgtgacttctggggccaggggaccctggcaccgtctcctcagcctccaccaaggccatcggtccctccccctgcaccctctccaangcactcgtggggcacagccgccctgggcctgccctggtcaaggctactccgtatctctcgctgacgcgggcctgggcaaacgggcgacangnnnnnnnnnnnnnnnnnnnnn

SEQ ID NO: 355302 - DNA, 504 bp, Homo sapiens
  misc_feature: GZ8MTXP02GAI68.11.39.D06.1.454.CMB.2.raw
  modified_base (491)..(504): a, c, t, g, unknown or other
  misc_feature (491)..(504): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtcccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcagcctccaccaacgggcccatcggtcccttccccctggccacccctccctccaacgacgccaccctcgtcgggggccacgagccgggccctggggcctcgccctggtaccaacgggacctacttccgtatcctctcgctgaggcgggctgggcaaggcgcatagnnnnnnnnnnnnnn

SEQ ID NO: 355303 - DNA, 485 bp, Homo sapiens
  misc_feature: GZ8MTXP02FMFB7.11.39.D06.1.454.CMB.2.raw
  modified_base (475)..(485): a, c, t, g, unknown or other
  misc_feature (475)..(485): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctatactgtgcgaggagtcctattacgcagctggctactacgttgacttctggggccaggggaccctggtcaccgtctcctcacgcctccaccaacgggcccactcggtcccttccccctcggccaccctcctccaacgacgccacctctgggggccacgagccggccctggggctgcctggtcaaggactacttcgtatctctcgctgagcgggctgggcaaggcgcgatagnnnnnnnnnnn

SEQ ID NO: 355304 - DNA, 494 bp, Homo sapiens
  misc_feature: GZ8MTXP02GYB1P.11.39.D06.1.454.CMB.2.raw
  modified_base (480)..(494): a, c, t, g, unknown or other
  misc_feature (480)..(494): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttctggggccaggggaccctggtcaccgtctcctcacgcctccaccaacgggcccatcggtcccttccccctggccacccctcctccaagcgccacctcgtgggggccacgacgccggccctgggcctgccgtggtcaaggactacttccgtatctctcgctgacgcgggctcgggcaacggcacatagnnnnnnnnnnnnnnn

SEQ ID NO: 355305 - DNA, 553 bp, Homo sapiens
  misc_feature: GZ8MTXP02GQ2CR.11.39.D06.1.454.CMB.2.raw
  modified_base (374)..(374): a, c, t, g, unknown or other
  misc_feature (374)..(374): n is a, c, g, or t
  modified_base (539)..(553): a, c, t, g, unknown or other
  misc_feature (539)..(553): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgacttcgtggggccaggggaccctggtcctaccgtctcctcacgccctccaccgaacgggccccacgtccggtccccttccccccgnggcccaccccctcctaccaagcgccacccgtcgtcgggggccacgacggcccgggcccgtgggccctcggacccgtgggaccgtaaacgggtacccttaccgtttcccgtattccttcgtccgcgttggacggccggggctcgggacgaacgggtcgacagtagnnnnnnnnnnnnnnn

SEQ ID NO: 355306 - DNA, 537 bp, Homo sapiens
  misc_feature: GZ8MTXP02GZU1O.11.39.D06.1.454.CMB.2.raw
  modified_base (365)..(365): a, c, t, g, unknown or other
  misc_feature (365)..(365): n is a, c, g, or t
  modified_base (517)..(537): a, c, t, g, unknown or other
  misc_feature (517)..(537): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgaggagtcctatacgcagctggctactacgttgacttcgtggggccaggggaccctggtcacccgtctcctcacgcctccacccaagggccccatccggtcccttccccccnggcccacccctccctccaagcgcccaccgtccgtacgggggcacgagcccggcccgtgggcctgcccgtggtccgaagggccttaacttcccggtaatccgtctccgcctaggacggtccggggcgtcgggacaacggggccacgaagtggnnnnnnnnnnnnnnnnnnnnn

SEQ ID NO: 355307 - DNA, 503 bp, Homo sapiens
  misc_feature: GZ8MTXP02F5VV1.11.39.D06.1.454.CMB.2.raw
  modified_base (485)..(503): a, c, t, g, unknown or other
  misc_feature (485)..(503): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtcccctccctcaagagtcgagtcaccatatcattagacacttccaagaaccaattctccctgaggttgacctctgtgaccactgcggacacggccgtctattactgtgcgagggagtcctatacgcagctggctactacgttgacttctggggccaggggacccctggtcacccgtctcctcacgccctccaccaacgggcccatccggtcccttccccctggccacccctccctccaagcgccaccctgtcgggggcacgagccggccctgggcctgcctggtcaggactaccttcgtatcgtctcgcctggagcgggctgggacaacggcgcagtagnnnnnnnnnnnnnnnnnnn

SEQ ID NO: 355308 - DNA, 579 bp, Homo sapiens
  misc_feature: GZ8MTXP02G53GV.11.39.D06.1.454.CMB.2.raw
  modified_base (558)..(579): a, c, t, g, unknown or other
  misc_feature (558)..(579): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtcccctccctcaagagtcgagtcaccatatcattagacacttccaagaaccaattctccctgagttgacctctgtgaccactgcggacacggccgtctattactgtgcgagggagtcctatacgcagctggctactacgttgacttcgtggggccaggggaccctggtcaccgtctcctcacgccctccacccgaaggggccccagtccggtccccttcccccgtggcccacccctccctaccaagcgccacctcgtgggggccacgacggcccgggcccgtggggccctcggcccgtcggggtaccgaaacgggtaccctaaccgtttccccggttaattcccttccgttccggccttacgggacgggtcccggggcggttacggggccaaacggggccgaccagttacggnnnnnnnnnnnnnnnnnnnnnn

SEQ ID NO: 355309 - DNA, 503 bp, Homo sapiens
  misc_feature: GZ8MTXP02HUFOI.11.39.D06.1.454.CMB.2.raw
  modified_base (218)..(218): a, c, t, g, unknown or other
  misc_feature (218)..(218): n is a, c, g, or t
  modified_base (462)..(462): a, c, t, g, unknown or other
  misc_feature (462)..(462): n is a, c, g, or t
  modified_base (486)..(503): a, c, t, g, unknown or other
  misc_feature (486)..(503): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaaagaaccaattctccctgaggttgacctntgtgaccactgcggacacggccgtctattactgtgcgagggagtcctattacgcagctggctactacgttgtacttcgtggggccacgggggaccctggtcaccgtctcctcacgcctccaccgacggcccagtccgtccccttccccctcggccacccctcctaccaacgcgccacctcgtcgggggcacgacgccggcccgtgggcctcgcctggtcaaggctacttccgatctctcgctgngcggcgtgggcaaggcgacagagnnnnnnnnnnnnnnnnnn

SEQ ID NO: 355310 - DNA, 472 bp, Homo sapiens
  misc_feature: GZ8MTXP02I3919.11.39.D06.1.454.CMB.2.raw
  modified_base (249)..(249): a, c, t, g, unknown or other
  misc_feature (249)..(249): n is a, c, g, or t
  modified_base (457)..(457): a, c, t, g, unknown or other
  misc_feature (457)..(457): n is a, c, g, or t
  modified_base (463)..(472): a, c, t, g, unknown or other
  misc_feature (463)..(472): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattacngtgcgagggagtcctattacgcagctggctactacgttgacttctgggccaggggaccctggtcaccgtctcctcagcctccaccaaggcccatcggtccttccccctgcaccctctccaagacgcacctctgggggcacacgcggcccctgggctgccctggtcaaggactacttccgatctctcgctgacgcggctggcaagggcncatagnnnnnnnnnn

SEQ ID NO: 355311 - DNA, 482 bp, Homo sapiens
  misc_feature: GZ8MTXP02HW8A0.11.39.D06.1.454.CMB.2.raw
  modified_base (471)..(482): a, c, t, g, unknown or other
  misc_feature (471)..(482): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactacgttgtacttctggggccaggggaccctggtcaccgtctcctcagcctccaccaggcccatcgtccctcccctcgcaccctcctccaagcgccacctctcgggggcacgagccggccctgggctcgccgtggtcgaaggacctacttccgatcctctcgctgacgtcgggctgggcaaggcgcagtgnnnnnnnnnnnn

SEQ ID NO: 355312 - DNA, 541 bp, Homo sapiens
  misc_feature: GZ8MTXP02JT98E.11.39.D06.1.454.CMB.2.raw
  modified_base (330)..(330): a, c, t, g, unknown or other
  misc_feature (330)..(330): n is a, c, g, or t
  modified_base (526)..(541): a, c, t, g, unknown or other
  misc_feature (526)..(541): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtcccctccctcaagagtcgagtcaccatatcattagacacttccaagaaccaattctccctgaggttgacctctgtgaccactgcggacaccggccgtctattactgtgcgagggagtctattacgcagctggctactacgttgacttcgtggggccgaggggaccctggtccaccgtctcctcncgcctccaccgaacgggcccacgtccggtccccttcccccgtggcccacccctccctaccaagcgccacctcgtcgggggccacgacgcccggccccgtgggcctcgccgtcggtcgaacggtacctccgtttacccgtacttcctcgtccgctcggacggccggggtcgtcgggacaacgggccgtcgagtacgnnnnnnnnnnnnnnnn

SEQ ID NO: 355313 - DNA, 539 bp, Homo sapiens
  misc_feature: GZ8MTXP02HOAEC.11.39.D06.1.454.CMB.2.raw
  modified_base (203)..(203): a, c, t, g, unknown or other
  misc_feature (203)..(203): n is a, c, g, or t
  modified_base (220)..(220): a, c, t, g, unknown or other
  misc_feature (220)..(220): n is a, c, g, or t
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
  modified_base (505)..(505): a, c, t, g, unknown or other
  misc_feature (505)..(505): n is a, c, g, or t
  modified_base (521)..(521): a, c, t, g, unknown or other
  misc_feature (521)..(521): n is a, c, g, or t
  modified_base (524)..(524): a, c, t, g, unknown or other
  misc_feature (524)..(524): n is a, c, g, or t
  modified_base (526)..(539): a, c, t, g, unknown or other
  misc_feature (526)..(539): n is a, c, g, or t
tcagcgagagataccacgaccggtgctcgatttagtgacatctcgcagttctttggggagtgtctaatgatatggtgactcgactcttgagggagggactggagtggattgggtacatctatgacggtggaagcaccacctacagtccctccctcaagagtcgagtcaccatatcattagacacttccaagaaccaatttccnccctgaggttgaccctntgtgaccactggcggacacggcctntattactgtgcgaggngtcctattacgcagctggctactacgttgacttcgtggggccgacggggacccgtggtccaccgtcctcctcacgccctccaccgaacgggcccagtccggtccccttccccccgtcggccaccccctcctccaacgcgccacctcgtacgggggccacgacgcccggcccgtggggcctcgccgtggtccgaaggtaccttaacgttcccgtactccttcgtccgtccgtggtcggcggggcngggacgaaggccgtanagngnnnnnnnnnnnnnn

SEQ ID NO: 355314 - DNA, 535 bp, Homo sapiens
  misc_feature: GZ8MTXP02HF7B7.11.39.D06.1.454.CMB.2.raw
  modified_base (376)..(376): a, c, t, g, unknown or other
  misc_feature (376)..(376): n is a, c, g, or t
  modified_base (513)..(535): a, c, t, g, unknown or other
  misc_feature (513)..(535): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaagaaccaattcctccctgaggttcgacctctgtgacccactgcggacacgggccgtctattactgtgcggagggatctatacgcagctggctactacgttgtacttcgtcggggccacggggtaccctggtcaccgtctccctcacgccctaccaccgaacgggcccagtccgtccccttcccccgnggccctccctcctaccaagcgcctaccgtcggtcggggccacgcgcccggcccgtggctcgcgtggtacacgtacctacgttccgtatcctccgtcgcgtggacgggccggtcgtacgggacgacggcgacaagtgnnnnnnnnnnnnnnnnnnnnnnn

SEQ ID NO: 355315 - DNA, 542 bp, Homo sapiens
  misc_feature: GZ8MTXP02FG87V.11.39.D06.1.454.CMB.2.raw
  modified_base (216)..(216): a, c, t, g, unknown or other
  misc_feature (216)..(216): n is a, c, g, or t
  modified_base (524)..(542): a, c, t, g, unknown or other
  misc_feature (524)..(542): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcacccacctacacgtcccctccctcaagagtcgagtcaccatatcattagacacttccaaagaaccaattctccctgaggttnacctctgtcgaccactgcggacacggccgtctattactgtgcgagggagtctattacgcagctggctactacgttgacttcgtggggccgaggggaccctggtccaccgtcctcctcacgccctcccaccgaacgggcccacgtccggtcccccttccccccgtcggccaccccctccctccaacgcgccaccctcgtcgggggcacgacgcccggcccgtgggcctcgccgtggtacgaacggacttacgttccgtactcctctcgctacggacggccgggcgtcgggcgaacgggccgacagtagnnnnnnnnnnnnnnnnnnn

SEQ ID NO: 355316 - DNA, 555 bp, Homo sapiens
  misc_feature: GZ8MTXP02H1TV4.11.39.D06.1.454.CMB.2.raw
  modified_base (246)..(246): a, c, t, g, unknown or other
  misc_feature (246)..(246): n is a, c, g, or t
  modified_base (539)..(555): a, c, t, g, unknown or other
  misc_feature (539)..(555): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaaagaaccaattcctccctgaggttcgacctctgtgaccatggacggacacggccgtntattactggtgcggagggacgtcctatacgcagcgtggctacgtacgttgacttcgtgggccgacggggtacccgtggtaccaccgtctcctcacgccctccacgaaaccgggcccacgtccggtcccccttcccccgtcggcccctacccgtccctacccaacgcgaccaccgtcggtcgggggccaacggcgtcccggcccgtgggcctcgcccgtggcgaaacggtcctaccgttccgtactctccgcgcgtggacggcgggcgtacgggaccgaaggccgacgagtagnnnnnnnnnnnnnnnnn

SEQ ID NO: 355317 - DNA, 530 bp, Homo sapiens
  misc_feature: GZ8MTXP02F941W.11.39.D06.1.454.CMB.2.raw
  modified_base (511)..(513): a, c, t, g, unknown or other
  misc_feature (511)..(513): n is a, c, g, or t
  modified_base (515)..(530): a, c, t, g, unknown or other
  misc_feature (515)..(530): n is a, c, g, or t
tcagcgagagataccacgaccggtgctcgatttagtgacatctcgcagttctttggggagtgtctaatgatatggtgactcggactcttgagggaagggactggagtggattgggtacatctatgacggtggaagcaccacctacagtccctccctcaagagtcgagtcaccatatcattagacacttccaagaaccaattctccctgaggttgacctctgtgaccactgcggacacggccgtctattactgtgcgagggagtcctattacgcagctggctactaacgttgacttctgggccaggggccctggtcaccgtctcctcagccctccaccaacggcccagtcgtcccttcccccctggccacccctcctcccaagcgccaccgtcgtcgggggcacgacgccggcccgtcgggctgaccctggtacaacgggacctacgttcccgtatcctcctccgtccgtagacggccggggcttacggggccaacggccgaccagtagcannncnnnnnnnnnnnnnnnn

SEQ ID NO: 355318 - DNA, 624 bp, Homo sapiens
  misc_feature: GZ8MTXP02IUM2U.11.39.D06.1.454.CMB.2.raw
  modified_base (301)..(301): a, c, t, g, unknown or other
  misc_feature (301)..(301): n is a, c, g, or t
  modified_base (600)..(602): a, c, t, g, unknown or other
  misc_feature (600)..(602): n is a, c, g, or t
  modified_base (604)..(608): a, c, t, g, unknown or other
  misc_feature (604)..(608): n is a, c, g, or t
  modified_base (610)..(610): a, c, t, g, unknown or other
  misc_feature (610)..(610): n is a, c, g, or t
  modified_base (612)..(612): a, c, t, g, unknown or other
  misc_feature (612)..(612): n is a, c, g, or t
  modified_base (614)..(624): a, c, t, g, unknown or other
  misc_feature (614)..(624): n is a, c, g, or t
tcagcgagagataccacgaccggtgctcgatttagtgacatctcgcagttctttgggagtgtctaatgatatggtgactcgactcttgagggaagggactggagtggattgggtacatactatgacggtggaagcaccacctacagtcccctccctcaagagtcgagtcaccatatcattagacacttccaaagaaccaattcctccctgaggttgacctctgtgaccactgcggacacggccgtctattacgtgtgcgagggtagtctattacgcagctggctactacgttgactttcgngggccgaggggtacccctggtcacccggtctccgtccacgtccctaccaacccgaaccgggcccctacgtcccggttcccccttcccccccgtggcccccacccccttcccctaccccgaaacggccggtcccaacccgttccgggtcggggggaccacgacgggcccggtccccgtcggggcctccggtcccgtcgggtaccgaaacggtaccgttaccgttaccgttacgtccctcgtccgtcgtacggcgggtcgggtccgtcggggacgaacgggggccctacgacggtaagcgnnncnnnnncncncnnnnnnnnnnn

SEQ ID NO: 355319 - DNA, 554 bp, Homo sapiens
  misc_feature: GZ8MTXP02FHEQH.11.39.D06.1.454.CMB.2.raw
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
  modified_base (529)..(529): a, c, t, g, unknown or other
  misc_feature (529)..(529): n is a, c, g, or t
  modified_base (531)..(533): a, c, t, g, unknown or other
  misc_feature (531)..(533): n is a, c, g, or t
  modified_base (535)..(541): a, c, t, g, unknown or other
  misc_feature (535)..(541): n is a, c, g, or t
  modified_base (543)..(548): a, c, t, g, unknown or other
  misc_feature (543)..(548): n is a, c, g, or t
  modified_base (550)..(554): a, c, t, g, unknown or other
  misc_feature (550)..(554): n is a, c, g, or t
tcagcgagagataccacgaccggtgctcgatttagtgacatctcgcagttctttgggagtgtctaatgatatggtgactcgactcttgagggaagggactggagtggattgggtacatctatgacggtggaagcaccacctacagtccctccctcaagagtcgagtcaccatatcattagacacttccaaagaaccaattccnccctgaggttgacctctntcgaccactgcggacacggccgtctattactgtgcgaggagtctattacgcagctggctactacgttgtacttcgtcggggccgaggggacccctggtcacccgtctcctcacgcctccacccgaaggcccactcggtccccttcccccctggccacccctccgtacccaacgacgccacctcgtcgggggcacacgggtccgcccgtggggctcgcccgtggtcccgaaacggacgttaaccttccgttaactcctcttccgcccgttaggacggtcggggcttcgggacgaacggccgcgaatagngnnncnnnnnnncnnnnnncnnnnn

SEQ ID NO: 355320 - DNA, 542 bp, Homo sapiens
  misc_feature: GZ8MTXP01BU30A.44.6.A06.1.454.CMB.2.raw
  modified_base (316)..(316): a, c, t, g, unknown or other
  misc_feature (316)..(316): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctntttttggctcactcacctacgcacgagaccttccggggcagaattacgaattaccgcggacaagtccacagacacagtctccatgacaatgagttcttagaaatccgacgacacggccgtcgtactactgtcgcgagcggtccgtaccccagtcctcgcatggagcctttgagacgtcgttgggggcacggggaacccctggtccattcgttctaaccttcgaacg

SEQ ID NO: 355321 - DNA, 528 bp, Homo sapiens
  misc_feature: GZ8MTXP01DB2N9.44.6.A06.1.454.CMB.2.raw
  modified_base (449)..(449): a, c, t, g, unknown or other
  misc_feature (449)..(449): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctcttttggctcactcacctacgcacgagaccttccggggcagaattacgaattaccgcggacaagtccacagacacagtctccatgacaatgagttctttagaaatccgacgacacgccgtctactactgtgcgngaggtccgtacccagctcgcatggagcctttgagatcgttgggggcagggaaccctggtcatgttctaaccttcgaacg

SEQ ID NO: 355322 - DNA, 582 bp, Homo sapiens
  misc_feature: GZ8MTXP01EBLDE.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtgcgccaggcccctggacaagggcttgagtggagtgggtgaatcatcccttcttttggctcactcacctacgcacgagtacccgttccggggacaagtaattacgaaacttacccgcggtaacaaacgtcccaacagacacagtctccatgacaatgtattctttagaaactccgacgacacgccgtactactactgtgcgagcggtccgtacccagtcctcgcaagtcgggacgttccgtttgacgtagtcggttacgggggcaacgggggtaacccctggggtaacctagtttcggacctaacccgttcgtaaccg

SEQ ID NO: 355323 - DNA, 558 bp, Homo sapiens
  misc_feature: GZ8MTXP01DQ0OL.44.6.A06.1.454.CMB.2.raw
  modified_base (317)..(317): a, c, t, g, unknown or other
  misc_feature (317)..(317): n is a, c, g, or t
  modified_base (471)..(471): a, c, t, g, unknown or other
  misc_feature (471)..(471): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtactaccagttccactacttatacccatcaactgggtgcgccaggcccctggacaagggcttgagtggatgggtgaatcactcccttnttttggctcactcacctacgcacgacgaccttccggggacagtaacttacgaacttaccgcggacaacgtccaacagacacagtctcatgacaatgagtttcttagaaactccgacgacacgccgtctactctgtcgcgagcggtccgtacccngtcctcgcagtcggagttcctttgacgtagtcggttgggggcaacggggtaaccctggtctagttcggttacctaaccttcgtaacg

SEQ ID NO: 355324 - DNA, 550 bp, Homo sapiens
  misc_feature: GZ8MTXP01BHO81.44.6.A06.1.454.CMB.2.raw
  modified_base (468)..(468): a, c, t, g, unknown or other
  misc_feature (468)..(468): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacagttgtccagtccctggtgcaactggtgcagtctgggactagaatgccgcaaccttggtcctcggtgacccctttcctgcacggcctctggaagtactaccagttccacttacttatacccatcaactgggtgcgccaggcccctggacaagggcttgagtggatgggtggaatcatccctcttttggctcactcacctacgcacgagacccttccggggcagaatacgaattaccgcgacaagtccacagacacagtctccatgacaatgagtttctttagaaactccgacgacacggccgtctactactgtgcgagcggtccctacccngtcctcgcatggacgcctttgagtagtcgttgggggcacggggaacccgtgggtcgtagttgttacctaaccgttcgaaccg

SEQ ID NO: 355325 - DNA, 580 bp, Homo sapiens
  misc_feature: GZ8MTXP01DFFVJ.44.6.A06.1.454.CMB.2.raw
  modified_base (269)..(269): a, c, t, g, unknown or other
  misc_feature (269)..(269): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttcccactacttatacccatcaactgggtncgccaggcccctggacaagggcttgagtggatgggtggaatcgatccctctttttggctcactcacctacgcacgacgaccttccgggggacagaacttacgaacttacccgcggacaagtcccacagacacagtctcatgacatgattcttagaaactccgacgtacacggcccgtctactactgtgcgagacgtcccgtaccccagtcctacgcaagtcggagttcctttaggagtagtccggttggggggccacgggggtaaccccttggggtccctaagttcgggttacctaacccttcgtaaccgg

SEQ ID NO: 355326 - DNA, 569 bp, Homo sapiens
  misc_feature: GZ8MTXP01C4GO8.44.6.A06.1.454.CMB.2.raw
  modified_base (477)..(477): a, c, t, g, unknown or other
  misc_feature (477)..(477): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtgaatcatccctcttttggctcactcacctacgcacgagacccgttccggggactagaaattacgaaacttaccgcggacaacgtccacagacacagtctccatgacaatgagtttctttagaaactccgacgacgacgccgtactactactgtcgcgagacggtccgtaccccngtcctcgcagtcggattcccgtttgacgtatcggttagggggccttaacgggggtaacccctgggtcagttcgttcctaaccgttcgtaacg

SEQ ID NO: 355327 - DNA, 597 bp, Homo sapiens
  misc_feature: GZ8MTXP01EJVNK.44.6.A06.1.454.CMB.2.raw
  modified_base (318)..(318): a, c, t, g, unknown or other
  misc_feature (318)..(318): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgccacggcctctggaagtactaccagttccactacttataccatcaactgggtgcgccaggcccctggacaagggcttgagtggatgggtggaatcactccctntttttggctcactcacctacgcacgagacccgttccggggcagaattacgaacttaccgcggacaagtccacagacacagtctccatgacaatgtatttctttagaaacttcccggaacgactaacgggcccgttactaaccttacgtgtcgacgaagacggttccccgtaccccaggtcctcggcacgtgggacgttccgtttagacggtagttcggttcggggggcaacgggggtaaccctgggtcctagttcggttaccctaaccgttcgtaaccg

SEQ ID NO: 355328 - DNA, 700 bp, Homo sapiens
  misc_feature: GZ8MTXP01DJP3H.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttatacccatcaactgggtgcgccaggcccctggacaagggcttgagtggatgggtggaatcatcccttcttttggctcactcaccttacgcacgacgtacccgttccgggggacagtaaacttaccgaaactttaacccggcgggaacaaacggtacccaacgacggacacacggttcccttacccaattcggaaccaaagttcgaagttttccttttagaaacttcccgaacgaacgaccgggtccccgttacttaacccgttacttggttacggaccgtaagggtaccggttccccggttaacccccaggtcccttccggcctaagtcggggtaacgttccccgttttaggaacgtaacggttccggttacggggggggccttaaaccgggggtaaacccccttgggggttcctaacgtttcggttaccctaacccgttcgtaacccgg

SEQ ID NO: 355329 - DNA, 640 bp, Homo sapiens
  misc_feature: GZ8MTXP01CSPYN.44.6.A06.1.454.CMB.2.raw
  modified_base (378)..(378): a, c, t, g, unknown or other
  misc_feature (378)..(378): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttctgcacggcctcgtggaagtactaccagttccactacttataccatcaacgtgggtcgccgccgacggccccgtaggaacgaagggcttggagtggagtgggtaggaatctactcccttgttttcggctcacctcacctacgcacgacgtacccgttccgggganaagtaactacgaacgttaacccgcggtaaccaaacgtacccaacaacgaccaacgacgtcctaccatacgactaatgtagtttcttagaaactcccgaacgtcgaccggtccttactacgtacgtgtcgacgtagtaccggtcccgtaccccagtccgtcgacagtcgggaacttccgtttagacggtacgtcgggttcgggggacacgggtaacccgttgggtaaccttagttccggttacctaacccgttcgtaacccgg

SEQ ID NO: 355330 - DNA, 557 bp, Homo sapiens
  misc_feature: GZ8MTXP01BSFU2.44.6.A06.1.454.CMB.2.raw
  modified_base (318)..(318): a, c, t, g, unknown or other
  misc_feature (318)..(318): n is a, c, g, or t
  modified_base (455)..(455): a, c, t, g, unknown or other
  misc_feature (455)..(455): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggcctctggaagtactaccagttccactacttatacccatcaactgggtgcgccaggcccctggacaagggcttgagtggatgggtggaatcatccctnttttggctcactcacctacgcacgagacccgttccggggcagaattacgaattacccgcggacaagtccacagacacagtctcatgacaatgtagttcttagaactccgacgacacggccgtctactactgtcgcgngacggtccgtacccagtcctcgcagtggacgccctttgagtagtcggttgggggttcgacggggtaacccgtggtctacttggttcctaaccgttcgaaccg

SEQ ID NO: 355331 - DNA, 560 bp, Homo sapiens
  misc_feature: GZ8MTXP01DFYIA.44.6.A06.1.454.CMB.2.raw
  modified_base (312)..(312): a, c, t, g, unknown or other
  misc_feature (312)..(312): n is a, c, g, or t
  modified_base (473)..(473): a, c, t, g, unknown or other
  misc_feature (473)..(473): n is a, c, g, or t
  modified_base (481)..(481): a, c, t, g, unknown or other
  misc_feature (481)..(481): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaatactaccagttccactacttatacccatcaactgggtgcgccaggcccctggacaagggcttgagtggatgggtgatcatcctnttttggctcactcacctacgcacgacgtacccttccggggacagaacttacgaacttacccgcggacaacgtccacagacacagtctccatgacaattgagtttctttagaaactccgacgacacggccgtactactactgtgcgagacggtccgtacccngtctcgcngtggacgttccgtttgagtacgtcggttcgggggcacggggtaacccttgggtctagttcgttacctccgttcgaaccg

SEQ ID NO: 355332 - DNA, 574 bp, Homo sapiens
  misc_feature: GZ8MTXP01EB990.44.6.A06.1.454.CMB.2.raw
  modified_base (487)..(487): a, c, t, g, unknown or other
  misc_feature (487)..(487): n is a, c, g, or t
  modified_base (562)..(562): a, c, t, g, unknown or other
  misc_feature (562)..(562): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcctgcacggcctctggaagtactaccagttccacttacttataccatcaactgggtcgcgccacggcccctggacaagggcttggagtggagtgggtgaatcattcccttgtttttggctcactcacctacgcacgacgcccgttccggggacagaacttacgaacttacccgcggtaacaacgtccaacagacacacgtctaccatgacaatgtattcttagaaactccgacgacacggccgtctactactgtcgacgagacggtcctaccccngtcctcgcagtcggacttcctttggacgacgtcggttgggggcacggggtaaccctgggtaacctagttcgaccncccttgaacccg

SEQ ID NO: 355333 - DNA, 567 bp, Homo sapiens
  misc_feature: GZ8MTXP01DD7C9.44.6.A06.1.454.CMB.2.raw
  modified_base (319)..(319): a, c, t, g, unknown or other
  misc_feature (319)..(319): n is a, c, g, or t
  modified_base (479)..(479): a, c, t, g, unknown or other
  misc_feature (479)..(479): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttcccactacttatacccatcaactgggtgcgccaggcccctggacaagggcttgagtggatgggtggaatcatcccctnttttggctcactcacctacgcacgagtacccgttccgggggacagaattaccgaattaccgcggacaagtcccacagacacagtctccatgacaatgagtttctttagaaatccgacgacacggccgtctactactgtcgcgtagacggtcccgtacccngtcctcgccagtcgggacttccgtttgacgtagtcgttggggggccaggggaacccctgggtcagttcgttcctaaccttcgtaaccg

SEQ ID NO: 355334 - DNA, 557 bp, Homo sapiens
  misc_feature: GZ8MTXP01ARRZX.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcctgcacggcctctggaagtactaccagttccactacttataccatcaactgggtgcgccaggcccctggacaagggcttgagtggatgggtggaatcatccctcttttggctcactcacctacgcacgagaccttccggggcagaattacgaacttaccgcggaacaacgtccaacagacacagtctccatgacaatgtagttcttagaaactccgacgtacacggccgtctactacgtgtgcgagcggtcccgtacccagtcctcgcagtcgacgttcctttggagagtcggttgggggcaggggtaaccccttggtctagttcgacctaaccgttgtaaccg

SEQ ID NO: 355335 - DNA, 567 bp, Homo sapiens
  misc_feature: GZ8MTXP01EHA5P.44.6.A06.1.454.CMB.2.raw
  modified_base (318)..(318): a, c, t, g, unknown or other
  misc_feature (318)..(318): n is a, c, g, or t
  modified_base (397)..(397): a, c, t, g, unknown or other
  misc_feature (397)..(397): n is a, c, g, or t
  modified_base (487)..(487): a, c, t, g, unknown or other
  misc_feature (487)..(487): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttatacccatcaactgggtgcgccaggcccctggacaagggcttgagtggatgggtggaatcatcccttntttttggctcactcacctacgcacgacgacccgttccggggcagaattacgaattaccgcggacaagtccacagaccanacgtctcatgacaatgtagtttcttagaaactccgaacgacacggtcctacgtactacgtgtcgcgagcggtccgtacccagtcctcgcngtggacttcctttgagtacgtcggttgggggccacggggaaccctgggtaacctagttcgttacctaaccgttcgaaccg

SEQ ID NO: 355336 - DNA, 584 bp, Homo sapiens
  misc_feature: GZ8MTXP01EVVZY.44.6.A06.1.454.CMB.2.raw
  modified_base (214)..(214): a, c, t, g, unknown or other
  misc_feature (214)..(214): n is a, c, g, or t
  modified_base (500)..(500): a, c, t, g, unknown or other
  misc_feature (500)..(500): n is a, c, g, or t
  modified_base (540)..(540): a, c, t, g, unknown or other
  misc_feature (540)..(540): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttccngcacggcctctggaagtactaccagttccactacttatacccatcaactgggtgcgccaggcccctggacaagggcttgagtggatgggtgaatcatcccttcttttggctcactcacctacgcacgagacccgttccggggacagaattaccgaattaccgcggacaagtccaacagacacagtctaccatcgaacaatgtaagttctttagaaacttccgaacgaccaacgggtcccttactaacttaaccgtgtcggacgacgtacggtcccgtaaaccccgngtccgtcgacagtcggtacgttcgttagagtacgtcgggnggggcgaccgggtaacctggtaactgttcgacctccgttcgtcg

SEQ ID NO: 355337 - DNA, 626 bp, Homo sapiens
  misc_feature: GZ8MTXP01D8HI2.44.6.A06.1.454.CMB.2.raw
  modified_base (317)..(317): a, c, t, g, unknown or other
  misc_feature (317)..(317): n is a, c, g, or t
  modified_base (528)..(528): a, c, t, g, unknown or other
  misc_feature (528)..(528): n is a, c, g, or t
  modified_base (539)..(539): a, c, t, g, unknown or other
  misc_feature (539)..(539): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaacgtactaccagttccactacttatacccatcaactgggtgcgccaggcccctggacaagggcttgagtggatgggtgaatcatcccttnttttggctcactcacctacgcacgagtacccgttccggggacaagtaacttaccgaaacttacccggcgggaacaaacgttcccaacaacggaacacaacgtcctaccaatcgaactaagtgtaacgtttctttaagaaacttcccggaacgacaccgggtcccttactaacttacgtggtcgacggacgtacggttccccgtaaacccgngtcctcggacncgtgggacttccgtttaggacgtaagtcgggttagggggcttacgggggaaccctgggtctagttcgttacctaaccgttcgaaccg

SEQ ID NO: 355338 - DNA, 585 bp, Homo sapiens
  misc_feature: GZ8MTXP01DB2ZS.44.6.A06.1.454.CMB.2.raw
  modified_base (272)..(272): a, c, t, g, unknown or other
  misc_feature (272)..(272): n is a, c, g, or t
  modified_base (323)..(323): a, c, t, g, unknown or other
  misc_feature (323)..(323): n is a, c, g, or t
  modified_base (462)..(462): a, c, t, g, unknown or other
  misc_feature (462)..(462): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgacccctttctgcacggcctcgtggaagtactaccagttcccaactacttatacccatcaactgggtncgccaggcccctggacaagggcttggagtggagtgggtgaatcatcccttnttttggctcactcacctacgcacgacgtacccgttccggggacagtaacttacgaacttaaccgcggacaacgtccaacacgacacagtctaccgatcgactaatgagtttcttagaaactccgaacgacacgggcctntaactcgtgtcgcgagcgtccctaacccgngtcncgcngtggtcgttcgttgacgtcgtcgggttacggggcgttaacgggtaacccgtggtcgtacgttcgttacctaaccgttcgtaaccg

SEQ ID NO: 355339 - DNA, 564 bp, Homo sapiens
  misc_feature: GZ8MTXP01BBER1.44.6.A06.1.454.CMB.2.raw
  modified_base (319)..(319): a, c, t, g, unknown or other
  misc_feature (319)..(319): n is a, c, g, or t
  modified_base (485)..(485): a, c, t, g, unknown or other
  misc_feature (485)..(485): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttcccactacttatacccatcaactgggtgcgccaggcccctggacaagggcttggagtggatgggtgaatcatcccttntttttggctcactcacctacgcacgagacccgttccggggcagaattacgaacttaccgcgacaacgtccacagacacagtctcatcgacaatgtagttcttagaaacgtccgacgacacgggtccgtacgtacttaccgtgtcgcgacgacggtcccgtaacccngtcctcgcagtgacgttccttgagtagtcggttgggggcacgggaaccctgggtcctagttcgttactccttcgaaccg

SEQ ID NO: 355340 - DNA, 614 bp, Homo sapiens
  misc_feature: GZ8MTXP01EZYFL.44.6.A06.1.454.CMB.2.raw
  modified_base (401)..(401): a, c, t, g, unknown or other
  misc_feature (401)..(401): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtacctaccagttccactacttatacccatcaactgggtgcgccaggcccctggacaaggcttgagtggagtgggtggaatcatccctcttttggctcactcacctacgcacgagacccgttcggggcaagaattacgaacttaccgcgacaacgtccacagacacacgtcnccatgacaatgtacgtttctttagaaactccgacgacgaaccggtccgttacgtaacttacgtgttacggacgtacgacggttcccgtaccccgaggtcctcgccaagtcggaacgttcccgtttggaacgtacgttcggttaacggggggccttaacgggggtaaccccgttgggtcccgtaagttcggttaccctaaccgttcgtaaccgg

SEQ ID NO: 355341 - DNA, 573 bp, Homo sapiens
  misc_feature: GZ8MTXP01B6MRA.44.6.A06.1.454.CMB.2.raw
  modified_base (317)..(317): a, c, t, g, unknown or other
  misc_feature (317)..(317): n is a, c, g, or t
  modified_base (476)..(476): a, c, t, g, unknown or other
  misc_feature (476)..(476): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccacggcccctggacaagggcttgagtggatgggtggaatcatccctnttttggctcactcacctacgcacgacgaccgttccggggacagaacttacgaattacccgcggacaagtccacacgacacagtctcatgacatgagttcttagaaactccgacgacacggtccgtactactactgtcgacgacgacgtcccgtaccccngtcctcgcagtggacgttcctttggagtacgtcggttacggggggcaacggggtaaccctgggtaacctagtttcggttcctaaccgttcgtaaccg

SEQ ID NO: 355342 - DNA, 612 bp, Homo sapiens
  misc_feature: GZ8MTXP01EODOG.44.6.A06.1.454.CMB.2.raw
  modified_base (387)..(387): a, c, t, g, unknown or other
  misc_feature (387)..(387): n is a, c, g, or t
  modified_base (414)..(414): a, c, t, g, unknown or other
  misc_feature (414)..(414): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggcctctggaagtacctaccggttccactacttataccatcaacgtgggtgcgccacggcccctggacaagggcttgagtggatgggtgaatcacttcccttcgttttggctcactcacctacgcacgagccgttccccggggcaagtaacttacgacttaacccggngaacaacgtccaacacgacacgagtcnccatgacaagtgacgtttactttagaaactccgaagaccacggtccgtactacgtactgtgacgaggcgtcccgtacccagccgtcgcagtcggaacgtcctttagggacgttacgtcggggtacgggggaccgttaccgggggttaaccccgttggggtacctaagttcggtccaacccgttcgaacgttaaccccg

SEQ ID NO: 355343 - DNA, 619 bp, Homo sapiens
  misc_feature: GZ8MTXP01BG8LS.44.6.A06.1.454.CMB.2.raw
  modified_base (370)..(370): a, c, t, g, unknown or other
  misc_feature (370)..(370): n is a, c, g, or t
  modified_base (509)..(509): a, c, t, g, unknown or other
  misc_feature (509)..(509): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccgttggtcctcggtcgacccctttctgcacggcctcgtggaacgtactacagttccacttacttataccatcaacgtgggtgcgccacggcccctggacaagggtcttgaggtggagtgggtgaatctactcccttgttttcggctcactcacctacgcacgagtacccgttccgggganaagtaacttacgaacttaccgcgaacaacgtccaacagacacacgtctacatcgacaattcgtatttcttagaactccgaacgacgacggtccgttactacgtacgtggtacgacgacgtaccggtcccgtaaccccgngtccgtcgcgtagtcgggtacgttcgttaggacggtcggtcgggttacgggggaccgttaccgggtaacccgttggtaaccgtacgttccgacctaacccgttcgtaacg

SEQ ID NO: 355344 - DNA, 580 bp, Homo sapiens
  misc_feature: GZ8MTXP01AML0A.44.6.A06.1.454.CMB.2.raw
  modified_base (317)..(317): a, c, t, g, unknown or other
  misc_feature (317)..(317): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtactaccagttccacttacttataccatcaactgggtgcgccaggcccctggacaagggcttgagtggatgggtggaatcatcccttnttttggctcactcacctacgcacgacgaccgttccggggcagaacttacgaacttaccgcggacaagtccacagacacagtctcatgacaatgattcttagaaactccgaacgacacggtccgtactactacgtgtacgacgagacggtcccgtaccccgagtccgtcgctagtggacgttccgtttagacgtagtcggttgggggccacgggggtaaccccttgggtaacctacgtttcggaccctaacccgttcgtaaccg

SEQ ID NO: 355345 - DNA, 668 bp, Homo sapiens
  misc_feature: GZ8MTXP01C6VPQ.44.6.A06.1.454.CMB.2.raw
  modified_base (355)..(355): a, c, t, g, unknown or other
  misc_feature (355)..(355): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctggggactagaatgccgcaaccttggtcctcggtgtaccctttctgcacggcctctggaagtactaccgtccactactataccatcaactgggtgcgcacggcccctggacaggctgagtggatgggtagatcattcccttcttttgctcacttcacctacgcacgagtaccgttccccgggganaagaacttacgacgttaaacccgacggaacaaacgtaccaacgaagaacacacgtcctacctaatcgaacaagttgtaacgtttactttacgaaaactcccggaaacgacgtaaccggtcccgttactaacttaacgtggtcgaccgaaggtaccggtacccgtaccccgaggtcctcggctaacgtcgggtaacgttcccgtttgggaacgttaggttccgggtcggggggttaccgttaccgggggttaaaccccgttggggtaccctaagtttccggtacccttacccgttaaccgaacggttaaccccg

SEQ ID NO: 355346 - DNA, 573 bp, Homo sapiens
  misc_feature: GZ8MTXP01DO10Y.44.6.A06.1.454.CMB.2.raw
  modified_base (315)..(315): a, c, t, g, unknown or other
  misc_feature (315)..(315): n is a, c, g, or t
  modified_base (355)..(355): a, c, t, g, unknown or other
  misc_feature (355)..(355): n is a, c, g, or t
  modified_base (485)..(485): a, c, t, g, unknown or other
  misc_feature (485)..(485): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccccttctgcacggcctctggaagtactaccagttccactacttataccatcaactgggtgcgccacggcccctggacaagggcttgagtggatgggtgatcatcccttnttttgctcactcacctacgcacgacgaccgttccgggganagaattacgaacttacccgcggacaacgtaccacacgacacacgtctccatgactaatgtagtttcttagaaactccgacgacgacgtccgtctactcgtgtcgcgagcggtccgtacccagtcctcgcngtcggacgttcctttaggagtacgtcggttcgggggcgacggggtaacccctgggtaacctaggttcgttcctaaccgttcgtaaccg

SEQ ID NO: 355347 - DNA, 607 bp, Homo sapiens
  misc_feature: GZ8MTXP01BM1EL.44.6.A06.1.454.CMB.2.raw
  modified_base (224)..(224): a, c, t, g, unknown or other
  misc_feature (224)..(224): n is a, c, g, or t
  modified_base (315)..(315): a, c, t, g, unknown or other
  misc_feature (315)..(315): n is a, c, g, or t
  modified_base (354)..(354): a, c, t, g, unknown or other
  misc_feature (354)..(354): n is a, c, g, or t
  modified_base (483)..(483): a, c, t, g, unknown or other
  misc_feature (483)..(483): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctntggaatactaccagttccactacttatacccatcaactgggtgcgccaggcccctggacaagggcttgagtggatgggtgatcatcccttnttttggctcactcacctacgcacgagacccttccggggnaagaattacgaacttacccgcggacaacgtccacagacacagtctccatgacaatgtagttcttagaaactccgaacgacacgggtccctacgtactccgtgtcgacgacgacgggtcccctaccccgngtccctcggacctagtaacgggacgttccctttgggacgtacgttccgggacggggggttccgaaacgggggtaaccccgttggggtaacctacgtttcggttacctaacccgttcgtaacccg

SEQ ID NO: 355348 - DNA, 579 bp, Homo sapiens
  misc_feature: GZ8MTXP01AWPBJ.44.6.A06.1.454.CMB.2.raw
  modified_base (313)..(313): a, c, t, g, unknown or other
  misc_feature (313)..(313): n is a, c, g, or t
  modified_base (455)..(455): a, c, t, g, unknown or other
  misc_feature (455)..(455): n is a, c, g, or t
  modified_base (483)..(483): a, c, t, g, unknown or other
  misc_feature (483)..(483): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtactaccagttccactacttataccatcaactgggtgcgccaggcccctggacaagggctgagtggatgggtgaatcatccctnttttggctcactcacctacgcacgagacccgttccggggcagaattacgaacttaccgcggacaacgtccacagacacagtcctcatgactaagtgtagttctttagaaactccgaacgacgacggtccgtctactacgtgngcgagacggtccgtacccagtcctcgcngtcggcttccgtttagagtacgttcgggttcgggggccttacgggggaaccccttgggtaacctagtttccggttacctaacccgttcgtaacccg

SEQ ID NO: 355349 - DNA, 586 bp, Homo sapiens
  misc_feature: GZ8MTXP01ALU8Q.44.6.A06.1.454.CMB.2.raw
  modified_base (253)..(253): a, c, t, g, unknown or other
  misc_feature (253)..(253): n is a, c, g, or t
  modified_base (521)..(521): a, c, t, g, unknown or other
  misc_feature (521)..(521): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctggggactagaatgccgcaaccttggtcctcggtgaccctttcctgcacggcctctggaagtactaccagttccactacttanaccatcaactgggtgcgccacggcccctggacaagggcttggagtggatgggtgaatcatcctcttttggctcactcacctacgcacgagaccccgttccggggcaaggaattacggaaactttacccggcggtaacaaacggtcccaacgagacacgacgtcctcatcgaacaatcgaagttctttagaaactccgacgacaccgggtcctcgtaactactgtgcgagcgtccgtacccacgctcgcacgtggacgttccgtttagngtacgtcggttgggggccacgggggtaacccctgggtctacgttcggttcaacccgttcaaccgg

SEQ ID NO: 355350 - DNA, 603 bp, Homo sapiens
  misc_feature: GZ8MTXP01A627S.44.6.A06.1.454.CMB.2.raw
  modified_base (213)..(213): a, c, t, g, unknown or other
  misc_feature (213)..(213): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcngcacggcctctggaagtactaccagttccactacttataccatcaactgggtgcgccacggcccctggacaagggcttgagtggagtgggtggaatcactcccttctttttggctcactcacctacgcacgacgacccgttccggggactaaggaacttacggaaacttaccggcggaacaaacgtccacagacacacgtctcatgacaatgtagttcttagaaactcgacgacacgggcctactactacgtgtcgcgacgtacggtccctaacccgagtcctcggacagtcggaacgttcctttaggacgtacgttcggttacgggggcttacgggggtaaccccgttgggtaaccgtaagttcggttacctaacccgttcgtaacccg

SEQ ID NO: 355351 - DNA, 608 bp, Homo sapiens
  misc_feature: GZ8MTXP01CIDXV.44.6.A06.1.454.CMB.2.raw
  modified_base (321)..(321): a, c, t, g, unknown or other
  misc_feature (321)..(321): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttctgcacggcctctaggaatactaccagttccactacttataccatcaacgtgggtgcgccacggcccctggacaaggcttgagtggagtgggtgaatcacttcccttnttttggcctactactcacctacgacacgacgtaccccgttccggggacaagtaacgttacgaaacttacccggcggaacaaacgtccaacaacgacacagtcctaccatacgactaatgtagtttacttagaaactccgaacgacacggtcccgtactacttacgtgtacgacgaggacgtccgtaccccagtccgtcgcagtggcgttcctttgaggtacgtcgggttacgggggcgaacggggtaacccctgggtaacctagttcgacctaaccgttcgtaaccg

SEQ ID NO: 355352 - DNA, 691 bp, Homo sapiens
  misc_feature: GZ8MTXP01D5NB2.44.6.A06.1.454.CMB.2.raw
  modified_base (322)..(322): a, c, t, g, unknown or other
  misc_feature (322)..(322): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttcctgcacggcctctggaagtactaccagttccactacttataccatcaacgtgggtgcgccacggcccctggacaagggtcttgagtggagtgggtgatcactcccttnttttcggctcactccacctacgcacgacgtacccgttccgggacagtaacttacgaacttaccgcggaacaacgtcccaacacgacacacgtcctaccaatgaactaatgtaacgtttctttaagaaactcccggaacaacgaccgggtacccttacgtaacgttacgtcggtacggacggtaacgggacccggttaccccgtaaccccgagtcccgttaccggactacggttaacggggaaccgttcccggttttagggaaacggtcggttccggggttacggggggggacccttaaacggggggtaaccccccttgggggtaaccctaacggtttccggaacccgtcccctttaacgtaaccccggg

SEQ ID NO: 355353 - DNA, 548 bp, Homo sapiens
  misc_feature: GZ8MTXP01BV1H9.44.6.A06.1.454.CMB.2.raw
  modified_base (316)..(316): a, c, t, g, unknown or other
  misc_feature (316)..(316): n is a, c, g, or t
  modified_base (473)..(473): a, c, t, g, unknown or other
  misc_feature (473)..(473): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctntttttggctcactcacctacgcacgagaccttccgggggcagattacgaacttaccgcggacagtccacagacacagtctccatgacaatgattctttagaatccgacgacacggccgtctactactgtgcgagcggtccctaccccgagtctcgcngtcgggagttcctttggagtagtcgttggggggcacggggtaacccctgggtctagttcgcctccgttcgaaccg

SEQ ID NO: 355354 - DNA, 692 bp, Homo sapiens
  misc_feature: GZ8MTXP01DVI0Z.44.6.A06.1.454.CMB.2.raw
  modified_base (319)..(319): a, c, t, g, unknown or other
  misc_feature (319)..(319): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttctgcacggcctcgtggaagtactaccagttccacttacttataccatcaactgggtgcgccacggcccctggacaagggctgagtggagtgggtgatcactcccttnttttgctcactcacctacgcacgacgtacccgttccggggataagtaacttaccgaaattacccgcggaacaaacggtcccaacgaacgacactacgtcctaccaatacgaactaagtgtaacgtttctttagaaactcccggaacgtaaccgaccggtcccgttactaacgttaacgttggtacggaccgtaacggtaccgggttacccccgttaacccccgaggtccccgttacggacccgtaaggttcgggaaccgttcccgttttagggaacggtaacgtttccgggggttaacggggggggccaaaccgggggtaaccccttgggtccttaacgtttccggttaaccctaacccgttaacgtaaccgg

SEQ ID NO: 355355 - DNA, 585 bp, Homo sapiens
  misc_feature: GZ8MTXP01DXW1X.44.6.A06.1.454.CMB.2.raw
  modified_base (324)..(324): a, c, t, g, unknown or other
  misc_feature (324)..(324): n is a, c, g, or t
  modified_base (369)..(369): a, c, t, g, unknown or other
  misc_feature (369)..(369): n is a, c, g, or t
  modified_base (500)..(500): a, c, t, g, unknown or other
  misc_feature (500)..(500): n is a, c, g, or t
  modified_base (505)..(505): a, c, t, g, unknown or other
  misc_feature (505)..(505): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttctgcacggcctctggaatactaccagttccacttacttatacccatcaacgtggtgccgccgacggcccctggacaagggcttggaggtggagtgggtgaatcacttccttnttttcggcttcactcacctacgcacgacgtacccgttccgggganaagtaattaccgaacttaccgcggaacaaacgtccaacagacacacgtctcatgaacatgtagtttcttagaaactccgacgacgaccgtccgtactactagtcgtacgcgacgtacggtcccgtaccccngtccncgccagtggtacgttcgtttagagtagtcggttcgggggcacgggtaaccctggtcctagtcgttcaaccgttcgaaccg

SEQ ID NO: 355356 - DNA, 609 bp, Homo sapiens
  misc_feature: GZ8MTXP01DNAIV.44.6.A06.1.454.CMB.2.raw
  modified_base (372)..(372): a, c, t, g, unknown or other
  misc_feature (372)..(372): n is a, c, g, or t
  modified_base (452)..(452): a, c, t, g, unknown or other
  misc_feature (452)..(452): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttctgcacggcctctggaagtactaccagttccactacttataccatcaacgtgggtgccgccacggcccctggacaagggcttgagtggagtgggtaggaatctactcccttcgtttttcggctcactcacctacgcacgacgtacccgttccgggganaaggtaattaccgaaacgttaccgcggacaaacgtccacacgacacacgtctaccatagactaatcgtaagtttctttanaaactaccgacgtacgaccgaccgttctactacgtgcgcgacgacggtcccgtacccacgtcctacgctagtcggtacgttccgtttgacgtacgtcggttgggggccgttacggggtaaccctgggtctacgttcgttcctaaccgttcgtaaccg

SEQ ID NO: 355357 - DNA, 582 bp, Homo sapiens
  misc_feature: GZ8MTXP01BTDK1.44.6.A06.1.454.CMB.2.raw
  modified_base (214)..(214): a, c, t, g, unknown or other
  misc_feature (214)..(214): n is a, c, g, or t
  modified_base (314)..(314): a, c, t, g, unknown or other
  misc_feature (314)..(314): n is a, c, g, or t
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttccngcacggcctctggaagtactaccagttccacttacttataccatcaactgggtgcgccaggcccctggacaaggctgagtggatgggtgaatcatccttntttgctcactcacctcgcacgngacttccggggcagatacgaattaccgngacaagtccacagacanacgtctccatcgaactaatgtaagtttctttagaaactccgacgacacgccgtactactacgtgtcgacgagtacggtccctaccccgagtcctcggactagtcggacgttccgtttagacgtacgtcgggttacgggggcgaaccgggggtaaccccttgggtaaccgttagttcggttaccctaaccgttcgtaacccg

SEQ ID NO: 355358 - DNA, 635 bp, Homo sapiens
  misc_feature: GZ8MTXP01DS48R.44.6.A06.1.454.CMB.2.raw
  modified_base (377)..(377): a, c, t, g, unknown or other
  misc_feature (377)..(377): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcctgcacggcctctaggaactactaccagttccacttacttactaccatcaacgtgggtcgcgccacggcccctaggacaagggcttggaggtggagtgggtagaactcacttcccttgtttttcggctcgactcacctacgcacgacgtacccgttccgggganagtaacttacgaaacttaccgcgtaacaaagtcccacacgacacgtacgtcctaccatagactaagtgtaacttcttaagaaactccgaaccgacgaacgtccgtactaactacgtggtcgacggagtaccgggtcccctaccccgagtccctcgacagtcggtacttccgtttgacgtacgttccgggcgggggaccaacggggtaacccctgggttaacctaacgttcggttaccctaacccgttcggtaaccccg

SEQ ID NO: 355359 - DNA, 587 bp, Homo sapiens
  misc_feature: GZ8MTXP01DLQ57.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttatacccatcaacttggtgcgccaggcccctggacaagggcttgagtggatgggtggaatcactcccttcttttggctcactcacctacgcacgacgtacccgttccgggggacagtaacttacgaaacttacccgcggacaagtacccacagacacagtctccatgacaatgaagttctttagaaactccgacgtacacggtccgtctactcgtgtgcgagcggttcccgtaccccagtcctcgctagtggacgttccgtttgagtacgtcggttcgggggccaacgggggtaaccccttgggtaacctagttcggttacctaacccgttctaaccg

SEQ ID NO: 355360 - DNA, 572 bp, Homo sapiens
  misc_feature: GZ8MTXP01EKOST.44.6.A06.1.454.CMB.2.raw
  modified_base (319)..(319): a, c, t, g, unknown or other
  misc_feature (319)..(319): n is a, c, g, or t
  modified_base (357)..(357): a, c, t, g, unknown or other
  misc_feature (357)..(357): n is a, c, g, or t
  modified_base (376)..(376): a, c, t, g, unknown or other
  misc_feature (376)..(376): n is a, c, g, or t
  modified_base (482)..(482): a, c, t, g, unknown or other
  misc_feature (482)..(482): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgccacggcctctggaagtactaccagttccacttacttatacccatcaactgggtgcgccaggcccctggacaagggcttgagtggatgggtgaatcatccttnttttggctcactcacctacgcacgagaccttccggggnagaattacgaacttaccgngacaagtccacagacacacgtctacatgacaatgtagtttctttagaaactccgacgacacggtccgtactacgtactgtcgcgaagaccggttccctaaccccgngtccacgctgtcggacgttcgttgagtcgtcgggacgggggccgaacggggtaacccttggtaactagttcgacctaaccgttcgtaacg

SEQ ID NO: 355361 - DNA, 591 bp, Homo sapiens
  misc_feature: GZ8MTXP01AXQB2.44.6.A06.1.454.CMB.2.raw
  modified_base (266)..(266): a, c, t, g, unknown or other
  misc_feature (266)..(266): n is a, c, g, or t
  modified_base (313)..(313): a, c, t, g, unknown or other
  misc_feature (313)..(313): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgtcgcaaccttggtcctcggtgaccctttctgcacggcctctggaagtactaccagttccactacttataccatcaactgggtncgcacggccctggacaagggcttgagtggatgggtgaatcatccctnttttggctcactcacctacgcacgacgaccgttccggggcagatacgaacttaccgcggacaagtccacagacacagtctccatcgactaatgtaactttcttagaactccgacgacacgtaccgtctactacgtgtcgcgagacggtcccgtaaccccgagtccgtacgctacggttcgggacgttcccgtttggaacggtcgttcgggttacggggggccaacgggggtaacccctgggtaacctagtttccggacctaacccgttcgtaacccgg

SEQ ID NO: 355362 - DNA, 646 bp, Homo sapiens
  misc_feature: GZ8MTXP01D4LFA.44.6.A06.1.454.CMB.2.raw
  modified_base (333)..(333): a, c, t, g, unknown or other
  misc_feature (333)..(333): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtcgtgggactagaatgccgcaaccgttggtcctcggtcgtaccctttctgcacggcctcgtggaatactacctacgttccactacttataccatcaacgtggtgcgccgaggcccctggacgaagggtctggagtggagtgggtaggaactctacttcccctttntttttcggcttccactcaccttacgcacgacgtacccgttccgggacagtaacttacgaacttaccgcggaactaacgtacccacgagacactacgtctaccatacgaactaatcgtagtttcttagaaacgtccgaacgaccacggtcccgttactaacgttacgtggttacgaccgaacggtacccggttcccgaccccgtagtccgtaccgccgtagtcggtaacgttccgtttaggacgtacggttcggggacggggttaccgacgggtaacccgtggtaactacgtcgttacctaaccgttcaaccgg

SEQ ID NO: 355363 - DNA, 635 bp, Homo sapiens
  misc_feature: GZ8MTXP01EGO0G.44.6.A06.1.454.CMB.2.raw
  modified_base (214)..(214): a, c, t, g, unknown or other
  misc_feature (214)..(214): n is a, c, g, or t
  modified_base (275)..(275): a, c, t, g, unknown or other
  misc_feature (275)..(275): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcngccacggcctcgtggaacgtacctacacgttcccacttacttataccatacaacgtgggtncgccacggcccctggacgaagggcttgaggtggagtgggtagatcattccccttgttttggctcactcacctacgcacgagtacccgttccggggactaagtaacttaccgaaacttacccggcggaacctaaacgtcccaaacagaacactacgtctaccatcgacaatgtacgttctttagaactccgaacgacacggtcctacgtactacgtgtcgacggagaccggtcccgtacccgagtcctacgccgtgtaacgggtcgttccgtttggaaggtacgttccgggttacgggggcaacccgggggtaacccctggggtaaccttcgttacggttcctaacccgttccgtaacccg

SEQ ID NO: 355364 - DNA, 600 bp, Homo sapiens
  misc_feature: GZ8MTXP01EMVUL.44.6.A06.1.454.CMB.2.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (266)..(266): a, c, t, g, unknown or other
  misc_feature (266)..(266): n is a, c, g, or t
  modified_base (313)..(313): a, c, t, g, unknown or other
  misc_feature (313)..(313): n is a, c, g, or t
  modified_base (403)..(403): a, c, t, g, unknown or other
  misc_feature (403)..(403): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtacagtctgggactagaatgccgcaaccttggtcctcggtgaccctttccngcacggcctctggaagtactaccagttccactacttanaccatcaactggtncgcaggcccctggacaggcttgagtggatgggtgaatcattcccttntttttggctcactcacctacgcacgagacgttccccggggcagaattacgattaacccgcgaacaagtcccaacagacacagtctccatnacatgtagtttacttagaaacttccgaacgacgaccgtccgttactacgtacttggtcgacgtaggaccgttccccgtaacccgagtcctcgacgtagtcggaacgtccgtttggacgttacgtcgggtaggggggaccgttacggggaccccgttgggtactaagtttcggcccttaaccgttccgaacgtccccg

SEQ ID NO: 355365 - DNA, 590 bp, Homo sapiens
  misc_feature: GZ8MTXP01APHU9.44.6.A06.1.454.CMB.2.raw
  modified_base (359)..(359): a, c, t, g, unknown or other
  misc_feature (359)..(359): n is a, c, g, or t
  modified_base (468)..(468): a, c, t, g, unknown or other
  misc_feature (468)..(468): n is a, c, g, or t
  modified_base (484)..(484): a, c, t, g, unknown or other
  misc_feature (484)..(484): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttctgcacggcctctggaagtactaccagttccactacttataccatcaactggtgcgccgacggcccctggacaaggcttgagtggagtgggtgaatcacttcccttcgttttggctcactcacctacgcacgacgaccgttccgggnaagtaacttacgaacttaccggcggacaacgtccacacgacacacgtcctaccatacgaactaagtgtagttactttagaaactccgacgacacggccgtctactctgngcgagcggtccacccngtcctcgctagtggtacgttcctttaggacgtacgtccgggttgggggccaacgggggtaaccccttgggtaacctacgtttcggttacctaaccgttccgtaacg

SEQ ID NO: 355366 - DNA, 580 bp, Homo sapiens
  misc_feature: GZ8MTXP01EZBTW.44.6.A06.1.454.CMB.2.raw
  modified_base (317)..(317): a, c, t, g, unknown or other
  misc_feature (317)..(317): n is a, c, g, or t
  modified_base (357)..(357): a, c, t, g, unknown or other
  misc_feature (357)..(357): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgacccctttcctgcacggcctctggaagtactaccagttccacttacttataccatcaactgggtgcgccaggcccctggacaagggcttgagtggatgggtgaatcatcctnttttggctcactcacctacgcacgagaccgttccgggganagaattacgaacttaccgcggtacaagtccacacgacacagtctaccatcgacaagtgtaagttctttagaaactccggacgacacggccgtactactactgtgcgagacggtccacccagctcgctagtcggaacgttccgtttaggacgtacgtcggcggggggttcaaccgggggtaaccctgggtaacctagttcggttacctaacccttcgtaacccg

SEQ ID NO: 355367 - DNA, 603 bp, Homo sapiens
  misc_feature: GZ8MTXP01CZRCA.44.6.A06.1.454.CMB.2.raw
  modified_base (289)..(289): a, c, t, g, unknown or other
  misc_feature (289)..(289): n is a, c, g, or t
  modified_base (531)..(531): a, c, t, g, unknown or other
  misc_feature (531)..(531): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggtctctggaacgtactaccagttccactacttataccatcaactgggtgcgccacggtcccagacgaaggnttgagtgagtggtgaatctactcccttcgttttcggcttcactcctacctacgacgacgtacgaccccggtttccggggactagtaaacgttacgtaaacgttaacccgcggaaacaaacgaccaacaacgacacacgtactccaatagacaatagtaagttacgtttacgtaactaccgacgacgacgtccgtacgtactacgtagtcgacgacgacggtccgtacccgacgtcctcgcgngtcgtcgttcgtcgttagtcgtcggcgggcggacggtaaccgtcgtcgtacgtcgttacgtcgttcgtaacg

SEQ ID NO: 355368 - DNA, 645 bp, Homo sapiens
  misc_feature: GZ8MTXP01CMNBX.44.6.A06.1.454.CMB.2.raw
  modified_base (382)..(382): a, c, t, g, unknown or other
  misc_feature (382)..(382): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagatgccgcaaccttggtcctcggtcgtacccctttcctgcacggtcctcgtaggaacgtacctacctacgttccacttacttactaccatcaacgtgggtcgcgcccacggccccgtggacagggcttgaggtggagtgggtagaatcgacttcccttgttttcgcttcactccacctacgcacgacgtacccgttccgggganagtaacttacgaacgttacccggcggaactaaacgtcccaacacgaacacgacgtcctacaatcgaactaatgtagtttcttagaactccgaacgacgaccggtccgttctactactgtacggacgacggtacggtaccccgtacccgagtcccgtcgcgtagtcgggtacgttccgtttaggacgtacggtcgggttcgggggaccttacggggtaaccccgtagggttcctacgtttcggacctaacccgttcgtaacccg

SEQ ID NO: 355369 - DNA, 577 bp, Homo sapiens
  misc_feature: GZ8MTXP01DDHSY.44.6.A06.1.454.CMB.2.raw
  modified_base (313)..(313): a, c, t, g, unknown or other
  misc_feature (313)..(313): n is a, c, g, or t
  modified_base (500)..(500): a, c, t, g, unknown or other
  misc_feature (500)..(500): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggctctggaatactaccagttccactacttataccatcaactggtgcgccacggcccctggacaagggcttgagtggatgggtgaatcatcccttnttttgctctactcactacgcacgacgacccgttcggggacagtaatacgaacttacccgcggaactaacgtcccaacacgacacacgtctccatagacaatgtagttactttagaaactccgacgactacgccgtactacgtactgtcgacgagtacgtccgtaccccagtcctcgctagtcggtanccgtttggacgtacgtcgggttacgggggttcaacggggtaaccctgggtctagttcgttacctccgttctaaccgg

SEQ ID NO: 355370 - DNA, 562 bp, Homo sapiens
  misc_feature: GZ8MTXP01DWWCZ.44.6.A06.1.454.CMB.2.raw
  modified_base (364)..(364): a, c, t, g, unknown or other
  misc_feature (364)..(364): n is a, c, g, or t
  modified_base (470)..(470): a, c, t, g, unknown or other
  misc_feature (470)..(470): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggcctctggaagtactaccagttccactacttatacccatcaactggtgcgccgaggcccctggacaagggcttagagtggagtgggtggaatcagttccctctttttggctctactcacctacgcacgacgaccttccgggganagtaattacgaacttacgcggacaacgtccacagacacagtctcatgacatgattcttgaactcgacacacgccgtactactcgtagtgcgagcgtccgtaacccngtcctcgcaagtgacgttcctttggagtacgttggttacggggggcttacggggaaccctgggtcacgttcggttcctaaccttcgtaaccg

SEQ ID NO: 355371 - DNA, 688 bp, Homo sapiens
  misc_feature: GZ8MTXP01EV0QI.44.6.A06.1.454.CMB.2.raw
  modified_base (598)..(598): a, c, t, g, unknown or other
  misc_feature (598)..(598): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtcgtgggactagaatgccgctaaccgtttggtccctcggttcgtaccccttttccgtgccaccggtcctctaggtaacgttacctacctacgttaccacttacttactacctatccaacgtgggtcgccgccgacggccccgtggacgaagggtcttggaggtggtagtggggtagaatcctacttcccctttgtttttcggccttcctactccacctacgccgacgtacgtaccccgttccggggactaagtaattaccgaacgttacccggaacggactaaacgtcccaacgacgaccactacgtcctaccgatacgaactaagttcgttaacgtttctttaaggaacctaccggaaccaccgtaccggtacccgttacttacgtaccgttggtacgtaccggacgtaccggtaccccgtaaccccgngtccgtccgacgtgtcggtacttcgtgacggtcggtacgggttcggggcgacgggtccgttgtaacttcgttcgacctccgttcgtaacg

SEQ ID NO: 355372 - DNA, 640 bp, Homo sapiens
  misc_feature: GZ8MTXP01BGNVG.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtcgtgggactagaatgccgcaaccgttggtcctcggtcgtacccctttcctgcacggcctcgtggaacgtactaccagttccacttacttataccatcaacgtgggtcgcgccgacggccccgtaggacaagggtcttggaggtggagtggggtaggaatctacttccctttgtttttcggctccactcacctacgcacgacgtacccgttccggggacaagtaacttacgaacttaccggcgacaacgtccacacgtacactacgtcctacatacgactaagtgtaactttcgtttagaaactccgaacgacgacggtcccttactacgttacgtgtcgacgacggtccggtacccgtaccccgagtcctacgctaggtcggacgttccgttaggacgtacgtcgggttcgggggacgttaccggggtaacccttgggtaactacgtttccgacctaaccgttcgtaaccg

SEQ ID NO: 355373 - DNA, 668 bp, Homo sapiens
  misc_feature: GZ8MTXP01A484B.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcctgcacggcctctggaagtactaccagttccacttacttataccactcaacgtggtcgccgccgacggccctggacgaagggtctgaggtggagtgggtagaacttcacttcccgtttcgtttttcggctccgactccacctacgcacggacgtaccccggttccggggactaagtaacttacgtaaacgttacccggcggaaacaacggtcccaacgtacgacacgacgtcctacaacgtacgaactaagtgttacgtttacttaagaaaccgtaccgaacgtaccacggtcccgttactaaccgtacttcggacgtaccgacggtacccggttacccgtaaacccccgcgtcccgtaccgacgtaggtcggtacgttcgttaggacgtacggtcgggcggggccgttaaccgggtccgtgtaacgtacgttcgttaccctaaccgttcgtccg

SEQ ID NO: 355374 - DNA, 655 bp, Homo sapiens
  misc_feature: GZ8MTXP01C7XFE.44.6.A06.1.454.CMB.2.raw
  modified_base (347)..(347): a, c, t, g, unknown or other
  misc_feature (347)..(347): n is a, c, g, or t
  modified_base (393)..(393): a, c, t, g, unknown or other
  misc_feature (393)..(393): n is a, c, g, or t
  modified_base (556)..(556): a, c, t, g, unknown or other
  misc_feature (556)..(556): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttgggtacctcggttcgaccctttctgcacggcctctggaacgtactaccagttccaacttacttactaccatcaacgttgggtcgccgccacggcccctaggaacgaaggggcttaggaggtggagttggggtaggaatccgacttccccgtttnttttggcctcactccacctacgcacgacgtaccccgttccgggganaagtaaacttacgaaacttacccggcggaacaaacgtccaacagaaccacacgtctaccatacgaaactaagtgtaagtttcctttaagaaacgtcccgaacgaacgtaccggtccgttactaacttacgtgtacggacgaacgtccggtacccgtaccccgngtacctcgcgtaacgtgggacttccgtttagacgttacgtcgggttacgggggcaaaccgggtcctgggtaactcgtcgttacctaaccgttctaaccg

SEQ ID NO: 355375 - DNA, 644 bp, Homo sapiens
  misc_feature: GZ8MTXP01B7FJW.44.6.A06.1.454.CMB.2.raw
  modified_base (214)..(214): a, c, t, g, unknown or other
  misc_feature (214)..(214): n is a, c, g, or t
  modified_base (373)..(373): a, c, t, g, unknown or other
  misc_feature (373)..(373): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcngccacggcctcgtggaagtactaccagttccacttacttataccatcaactgggtgcgccacggcccctggacaagggtcttggagtggagtgggtaggaatcacttcccttctttttggctcgactccacctacgcacgacgtacccgttccgggganaagtacttacgaacttaccgcggaacagtccacagaccacacgtctacatcgacaagtgtagtttctagaaactcgacgacgacgtcctacgtactacgtctacggcgaacgtaccggggtcccctaaccccgaggtccctacggacgacgttcgggtaacgttcccgtttaggacggttaacggttccggggacggggggttccaaaccgggggtaaccccttggggttcctaacggtttcgacccttaacccgttaacgttaacccggg

SEQ ID NO: 355376 - DNA, 684 bp, Homo sapiens
  misc_feature: GZ8MTXP01AQ2X9.44.6.A06.1.454.CMB.2.raw
  modified_base (578)..(578): a, c, t, g, unknown or other
  misc_feature (578)..(578): n is a, c, g, or t
  modified_base (588)..(588): a, c, t, g, unknown or other
  misc_feature (588)..(588): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgctaaccttggtcctcggtcgtacccctttccgtgccacggcctcgtaggtaacgtacctaccagttccctacttacttactaccatcaacgtgggtgccgccacggccccgtggacgaaggcttgaggtggagtgggtaggtatcacttccccttgttttggcctacacctcaccctacgcacggacgtacccggttccggggactaagtaacttaccgaacgttaccccgggcgaacgaaacgtcccaacaacgaccaacgtacgtacctacctaagtcgaataacgttggtaacgtttctttaacgaaaccgttacccggaaccgtaaccaccgggttcccgtacttacgttacgtcgtacggacggacgtaccggtaccccgtacccgngtcctccggntacgtcggtacgttccgtttagaccgtaggttcgggttcgggggccaacgggggtaacccttgggtccgtagttccggacctccgttcgtaacccg

SEQ ID NO: 355377 - DNA, 628 bp, Homo sapiens
  misc_feature: GZ8MTXP01A3YRV.44.6.A06.1.454.CMB.2.raw
  modified_base (270)..(270): a, c, t, g, unknown or other
  misc_feature (270)..(270): n is a, c, g, or t
  modified_base (324)..(324): a, c, t, g, unknown or other
  misc_feature (324)..(324): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttctgcacggcctctggaacgtactaccagttccaattacttataccatcaacgtgggtncgccgacggcccctggacgaaggcttggagtggagtgggtagaatcatcccttnttttggctcactcacctacgcacgacgtacccgttccggggacaagtaacttacgaaacttacccggcggaactaaacgtcccaacgagaacactacgtactacatacgaactaagtagtacgtttacgttacgtaacgtaccgacgaacgaccgtaccgtactacgtacgtcgtacgcgacgtacgtacccgtacccacgtccgtcgcgagtcggacgttccgtttggacgtagttcccccggttagggggccgacgggtaacccgtcggtaacgtacgttcgttactaaccgttcgtaaccg

SEQ ID NO: 355378 - DNA, 610 bp, Homo sapiens
  misc_feature: GZ8MTXP01BAJV9.44.6.A06.1.454.CMB.2.raw
  modified_base (214)..(214): a, c, t, g, unknown or other
  misc_feature (214)..(214): n is a, c, g, or t
  modified_base (278)..(278): a, c, t, g, unknown or other
  misc_feature (278)..(278): n is a, c, g, or t
  modified_base (333)..(333): a, c, t, g, unknown or other
  misc_feature (333)..(333): n is a, c, g, or t
  modified_base (377)..(377): a, c, t, g, unknown or other
  misc_feature (377)..(377): n is a, c, g, or t
  modified_base (526)..(526): a, c, t, g, unknown or other
  misc_feature (526)..(526): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcngcacggtcctcgtggaagtacctaccagttacccacttacttaactaccatctaacgttggtcnccgccacggcccctggactaagggcttggagtggagtgggtgatcacttcccttnttttggctcactccacctacgcacgacgtacccgttccgggganaagtaacttacgtaacttacccggcgggaacaacgtcccaactacgacacgtacgtcctacgatgaactaagtgtaagtttcttaagaaactccggaacgtacgaccggtcctacgtactacgttgcgacgagccggtccctaacccgngtcctcgctgtcgcttcgtagacgtcggtcgggcgggccgttaacggtccgtggtctgttccgttacctaaccgttcgtaaccg

SEQ ID NO: 355379 - DNA, 634 bp, Homo sapiens
  misc_feature: GZ8MTXP01DMSCX.44.6.A06.1.454.CMB.2.raw
  modified_base (388)..(388): a, c, t, g, unknown or other
  misc_feature (388)..(388): n is a, c, g, or t
  modified_base (539)..(539): a, c, t, g, unknown or other
  misc_feature (539)..(539): n is a, c, g, or t
  modified_base (548)..(548): a, c, t, g, unknown or other
  misc_feature (548)..(548): n is a, c, g, or t
  modified_base (568)..(568): a, c, t, g, unknown or other
  misc_feature (568)..(568): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtcgtgggactagaatcgccgcaaccgttggtccctcggtcgtacccctttctcgcgacggcctcgtaggaacgttacctacctagttcccactacttactaccatcaacgtggtgccgccacggcccctggaacgaagggcttaggaggtggagtgggtaggtatctactccctttgttttcgctctactcacctacgcacgagtaccccgtccgggganagtaacttacgaaacgttacccggcgaacaaaccgtccaacacgtacacacgtccaccgatagaactaagttgtaacgtttcgttaagaaacgtcccgacgacaacggtccctataccgtagtgtagcgtacggtccgttacccaacccgngtccgtcgngtagtcgtcgttcgttaggngtcggtcgggacggggaccgttaccgggtaaccctggtcttacgtccgttaccctccgttcgtccg

SEQ ID NO: 355380 - DNA, 788 bp, Homo sapiens
  misc_feature: GZ8MTXP01BMRNB.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcctgccacggcctctaggaacgtactaccagttcccaacttacttactaccatcaacgtgggtcgccgccgacggcccccgtaggaccgaagggcttggaggtggagtggggtaggaactctacttccccgtttacgtttttcgggccttaccgtaccttcccaacccgtaccgtaccgaaccggtacgtacccccggtttcccgggggactaaacgtaaactttaacccggaaactttaacccgggccgggaaactaaacgtaccccgaacgaacgtaaccaacgtaacgtaccctaccctaagttacgaaacctaaagttcggttaaacgtttacccgtttaaggaaaaccttccccggaaaccgtaaccgaacccggggttacccgttaccgttaacccttaacggttacgtacgggtaccggaaaccggtaccggttaccccggtaaaccccgagtcccgttccgacgtagtcgggtacgttcccgttttaggacgtaaggtccggttacgggggccgttaacggggtaaccccttgggtaacctagtttccggacctaaccgttcgaaccg

SEQ ID NO: 355381 - DNA, 627 bp, Homo sapiens
  misc_feature: GZ8MTXP01CU8NN.44.6.A06.1.454.CMB.2.raw
  modified_base (273)..(273): a, c, t, g, unknown or other
  misc_feature (273)..(273): n is a, c, g, or t
  modified_base (368)..(368): a, c, t, g, unknown or other
  misc_feature (368)..(368): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctggggactagaatgccgcaaccttggtcctcggtcgaccctttctgcacggcctcgtaggaagtacctaccagttccaactacttataccatcaacgtgggtncgccacggcccctaggacaaggcttgagtgagtgggtgaatcacttcccttgttttggctcactcacctacgcacgacgtacccgttccgggganagtaaactacgaacttacccgcggaacaaacgtacccaacagaacacaacgtcctaccaagtacgaactaaagttgtaagtttctttaagaaactaccgacgtaacgacggtcctactaactacgtgtacgcgacgtcggtccctaccccaggtcctcgacaagtcggtcgttccgtttggacgtaacggtcggacgggggacgaaccggggtaaccccttgggtaaccttagttcggaccctaaccgttcgtaacccg

SEQ ID NO: 355382 - DNA, 944 bp, Homo sapiens
  misc_feature: GZ8MTXP01BSRBO.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccgttggtcctcggtcgtacccctttctgccacggcctcgtggaacgtactaccagttaccactacttataccatcaacgtgggtacgccgccgacggccccgtggacgaacgggtcttcggaggttcgggagttgggggtagggtaaacttccgtaacgtttcccccgttttacgttttttttcgggaccctttaccccgtaaccgtttcccgtaaacccccgtttaaccggacccgtaaaccggggtaaccggttaaccccccggttttccccgggggggacttaaaacgggttaaaccgttttaaacccgggtaaaacccgttttaaaccccgggaaccggggtaaacccgtaaaacccgggttaccccaaaaccggaaacggtaacccaaaccggttacggtttaccctaacccgtaaagttacggtaaacctaaaggttacggttaaacggtttttaccttttaaacggaaaccgttaccccggaaacggaaccccggtaaaccggggttccccgttaacggttaaccgttacggtttcggtaacgggtccggtaaacgggtaccccgggttaccccggttaacccccgaggttccccttaccgggaaccttagggtcggggttaaccgttcccggttttaggaaccggttaacgtttccgggggttacggggggaccgttaaccgggggtaaccccttaggggttccttaacggttcgttacccgtaacccgttaaccggttaacccgg

SEQ ID NO: 355383 - DNA, 588 bp, Homo sapiens
  misc_feature: GZ8MTXP01E1S5S.44.6.A06.1.454.CMB.2.raw
  modified_base (373)..(373): a, c, t, g, unknown or other
  misc_feature (373)..(373): n is a, c, g, or t
  modified_base (469)..(469): a, c, t, g, unknown or other
  misc_feature (469)..(469): n is a, c, g, or t
  modified_base (490)..(490): a, c, t, g, unknown or other
  misc_feature (490)..(490): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcctgcacggcctctggaagtactaccagttccactacttataccatcaactgggtgccgccacggccccctggacgaagggtcttggaggtggagtggggtggaatcactcccctttcttttggctcactccacctacgcacgacgtacccgttccggggnagaacttacgaacttaccgcggacaacgtccacagacacagtctcatgacaagtgtagttcttagaactccgacgacgaccgccgtctactactgngcgagccggtcccgtaccccngcctcgcagtgggacgttcccttggacgtacgtcgggcggggggcgaccgggggtaaccccgtgggtcctacgttcgaccctaacccttcgtaaccgg

SEQ ID NO: 355384 - DNA, 702 bp, Homo sapiens
  misc_feature: GZ8MTXP01DYZDL.44.6.A06.1.454.CMB.2.raw
  modified_base (563)..(563): a, c, t, g, unknown or other
  misc_feature (563)..(563): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccccttttctgccaccggccttcgtaggaacgtacctaacctagttcccaacttactttataccatactaaacgtgggtcgccgccgacggccccctggacgaagggtcttggaggtggagtgggaggaatctactccccttgttttcggctcactccacctacgcacgacgtaccccgttccggggacaagtaaacttacgaacgttaaccgcggtaacaacgtacccaacgagacacacgtctaccgatgaactaagtgtacgtttactttaggaaactcccggaacgaccgaccgggtacccttacgtaacttacgtggtacgacggtacggtacggtccccgtaaaccccgngtccgtacgacgtggtcgggtacgttcgtttacgggaacggttccggttccggggttacgggggttacccggttaaaccggggttaacccgttcggttaaccgttacggttccgttaccccgtaaccgttccgtaaccg

SEQ ID NO: 355385 - DNA, 622 bp, Homo sapiens
  misc_feature: GZ8MTXP01ALDV2.44.6.A06.1.454.CMB.2.raw
  modified_base (375)..(375): a, c, t, g, unknown or other
  misc_feature (375)..(375): n is a, c, g, or t
  modified_base (525)..(525): a, c, t, g, unknown or other
  misc_feature (525)..(525): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttctgcacggcctcgtggaagtactaccagttccacttacttataccatcaacgtgggtcgcgccgacggcccctaggacgaagggcttggagtggagtgggtagaactctactccctttgttttcggctcactccacctacgcacgacgtcccgttaccggggnagtaactacgaacttacccggcgactaaagtccacagacacgtagtcctaccatacgaactaattggtacgtttacttagaaactcccggacgaccgaccgggtccttactacgttacgtgtcggacggacgtacggtcccctaacccgngtccgtacgcagtcgggacgttccgttagacgtcgtcgggttcgggggccttacggggtaaccctggtctagttcggacctaaccgttcgtaaccgg

SEQ ID NO: 355386 - DNA, 625 bp, Homo sapiens
  misc_feature: GZ8MTXP01CIBGT.44.6.A06.1.454.CMB.2.raw
  modified_base (395)..(395): a, c, t, g, unknown or other
  misc_feature (395)..(395): n is a, c, g, or t
tcagacagtatatacacgaccggtgctcgatttagatctactgacaaccacattcctcctctaaagaagccccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttcctgccacggcctcgtaggaacgttacctacctagttccacttacttactaccatcaacgtgggtcgcgccgacggcccctggacgaagggtcttggaggtggagtggggtaggaatctacttccccgttctttttcggctcctactccaccgtacgcacggacgtaccccgtccggggnaagtaacttacgaaacttaccgcgaacaagtcccacacgacacacgtcacatgactatgtagttcttagaactccgacacgcgtccgtacttactacgtgtcgacgtacggccggtacccgtacccagtcctcgcacggtcggacgttccgtttagacggtacgtcgggttacgggggccgttacggggtaacccttgggtctagttcggttacctccgttcgtaacccg

SEQ ID NO: 355387 - DNA, 623 bp, Homo sapiens
  misc_feature: GZ8MTXP01BDIIV.44.6.A06.1.454.CMB.2.raw
  modified_base (410)..(410): a, c, t, g, unknown or other
  misc_feature (410)..(410): n is a, c, g, or t
  modified_base (512)..(512): a, c, t, g, unknown or other
  misc_feature (512)..(512): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccgttggtcctcggtcgaccctttctgcacggcctctggaacgtactaccagttccactacttataccatcaacgtggtgccgccgacggcccctggacgaaggcttggagtggagtgggtgaacgtcgtatcccttgttttggactcactcactacgcacgacgtaccgtccggggacaggtactacgaacttaccgcgacaacggtccacagacacganactccatcgacgaattgtacgttatttacaaactccggacgacgaccggtaccgtcgttaaccgtatacggtcggacggtacgtaccggtccgtaaccccgngtcccgtacgcgtacggtcggtacgttccggttagacggtacgtcgggttcggggaccggacgggtaacccggtggtaacccgtgttcgttacccgtcccgttcgtaaccg

SEQ ID NO: 355388 - DNA, 564 bp, Homo sapiens
  misc_feature: GZ8MTXP01A6JO0.44.6.A06.1.454.CMB.2.raw
  modified_base (266)..(266): a, c, t, g, unknown or other
  misc_feature (266)..(266): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (478)..(478): a, c, t, g, unknown or other
  misc_feature (478)..(478): n is a, c, g, or t
  modified_base (483)..(483): a, c, t, g, unknown or other
  misc_feature (483)..(483): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtactacagttccactacttataccatcaactggtgcncaggccctggacaagggcttgagtggatgggtaggaatcaattccctatttttggctcactcacctacgcacgagaccgttcgggacagtaatacgaattaccgcgacaagtcacagacacagtcnctaanananatagtagtactagtacacgacgacgacgtacgtacgtacgtacgtcgtacgacgacgtacgtaccgtaccgacgtcncgcgngtcgtacgttcgttcgacgtacgtcggttcgggcggacggtaaccgtcggtaacgtagtcgttacctaaccgttcgtaacg

SEQ ID NO: 355389 - DNA, 538 bp, Homo sapiens
  misc_feature: GZ8MTXP02FVW5E.44.6.A06.1.454.CMB.2.raw
  modified_base (318)..(318): a, c, t, g, unknown or other
  misc_feature (318)..(318): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggcctctggaagtactaccagttccactacttatacccatcaactgggtgcgccaggcccctggacaagggcttgagtggatgggtggaatcatccctnttttggctcactcacctacgcacgagaccttccggggcagaattacgattaccgcggacaagtccacagacacagtctccatgacaatgagttctttagaaactccgaacgacacggccgtctactactgtgcgagaggtcccgtaccccagctcgcatcggagtcctttgagatcgtcgggggcacggggaaccctgggtccagttcgtacacctcacg

SEQ ID NO: 355390 - DNA, 549 bp, Homo sapiens
  misc_feature: GZ8MTXP02G13CD.44.6.A06.1.454.CMB.2.raw
  modified_base (268)..(268): a, c, t, g, unknown or other
  misc_feature (268)..(268): n is a, c, g, or t
  modified_base (315)..(315): a, c, t, g, unknown or other
  misc_feature (315)..(315): n is a, c, g, or t
  modified_base (441)..(441): a, c, t, g, unknown or other
  misc_feature (441)..(441): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggcctctggaagtactaccagttccactacttataccatcaactgggtncgccaggcccctggacaaggcttgagtggatgggtgaatcatccctnttttggctcactcacctacgcacgagaccgttccggggcagaacttacgacttaaccgcggaacaagtccacagacacagtctccatgacatgagttcttagaaatccgacgacacggctctactntagtgcgaagacggtccgtacccagcctcgcactggacgtcctttgacgtagtcggtcgggggaccacggggaacccgtgggtactacgttacggtcaccgttcaccg

SEQ ID NO: 355391 - DNA, 567 bp, Homo sapiens
  misc_feature: GZ8MTXP02JFOLG.44.6.A06.1.454.CMB.2.raw
  modified_base (267)..(267): a, c, t, g, unknown or other
  misc_feature (267)..(267): n is a, c, g, or t
  modified_base (314)..(314): a, c, t, g, unknown or other
  misc_feature (314)..(314): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtncgccaggcccctggacaaggcttgagtggatgggtgaatcatccctnttttggctcactcacctacgcacgacgaccgttccggggcagaattacgattaccgcgacaacgtccacagacacagtctccatgacatgtagttcttagaaactccgacgacacggccgtactactacgtgtcgcgagacggtcccgtacccagctcgcacttcgggactccgtttgacgtacgtcgtacgggggcaacgggggtaaccccgtggggtacctacggttcggtaccctaccgttcgaacccgg

SEQ ID NO: 355392 - DNA, 542 bp, Homo sapiens
  misc_feature: GZ8MTXP02HG7BV.44.6.A06.1.454.CMB.2.raw
  modified_base (316)..(316): a, c, t, g, unknown or other
  misc_feature (316)..(316): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttcccactacttataccatcaactgggtgcgccaggcccctggacaagggcttgagtggatgggtggatcatccctnttttggctctactcacctacgcacgagactttccggggcagaattacgattaccgcggacaagtccacagacacagtctccatgacaatgagttcttagaaaatccgacgacacggccgtctactactgtgcgagacggtccgtaccccagctcgcagtcggacgcctttgacgagtcgtacgggggcacggggaacccgtggtacctagttcgtcaccgttcacg

SEQ ID NO: 355393 - DNA, 523 bp, Homo sapiens
  misc_feature: GZ8MTXP02IS6O4.44.6.A06.1.454.CMB.2.raw
  modified_base (356)..(356): a, c, t, g, unknown or other
  misc_feature (356)..(356): n is a, c, g, or t
  modified_base (436)..(436): a, c, t, g, unknown or other
  misc_feature (436)..(436): n is a, c, g, or t
  modified_base (451)..(451): a, c, t, g, unknown or other
  misc_feature (451)..(451): n is a, c, g, or t
  modified_base (476)..(476): a, c, t, g, unknown or other
  misc_feature (476)..(476): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactaaagaatgccgcaaccttggtcctcggtgacccctttctgcacggcctctggaagtactaccagttcccactacttataccatcaactggtgcgccaggcccctggacaagggcttgagtggatgggtggaatcatccctcttttggctcactcacctacgcacgagaccttccggggnagaattacgattaccgcggacaagtccacagacacagtctccatgacaatgagttcttagaaatccgacgacacggcctntactactgtgcgagnggtccgtacccagctcgcagtggancctttgagactcgtgggggcagggaaccctggtcatgtcacctcacg

SEQ ID NO: 355394 - DNA, 552 bp, Homo sapiens
  misc_feature: GZ8MTXP02G2ONC.44.6.A06.1.454.CMB.2.raw
  modified_base (253)..(253): a, c, t, g, unknown or other
  misc_feature (253)..(253): n is a, c, g, or t
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggcctctggaagtactaccagttccactacttanacccatcaacttggtgcgccaggcccctggacaagggcttgagtggatgggtgaatcatccctctttttggctcactcacctacgcacgngaccttccggggnagatacgattaccgcgacaagtccacagacacacgtctcatgacaatgagttcttagaaatccgacgacacggccgtctactctagtgacgagacgtcccgtacccagctcgcagtcggacgtcctttgacgtacgtcgtacgggggcaacgggggaacccttggggtacctattcggtaccaccttactaaccgg

SEQ ID NO: 355395 - DNA, 549 bp, Homo sapiens
  misc_feature: GZ8MTXP02GQB1Y.44.6.A06.1.454.CMB.2.raw
  modified_base (396)..(396): a, c, t, g, unknown or other
  misc_feature (396)..(396): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgccacggcctctggaatactaccagttccactacttataccatcaactgggtgcgccaggcccctggacaaggcttgagtggatgggtggaatcatccctcttttggctcactcacctacgcacgagaccgttccggggcagaattacgattaccgcggaacaagtccacagacacagtcncatgacatgattcttagaaatccgacgacacggccgtctactactgtgacgagacggtccgtacccagcctcgacagtcggagtcctttgagtacgtcgtacgggggcaacggggaaccccgtggacgtacttcggcctaacccttcgaaccg

SEQ ID NO: 355396 - DNA, 573 bp, Homo sapiens
  misc_feature: GZ8MTXP02FN3UM.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacagttgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatcccttcttttggctcactcacctacgcacgagaccgttccggggcagaattacgattaccgcgacaacgtccacagacacagtcctccatgaacaaatgtagttctttagaaactccgaacgacaccggccgtctactactgtgcgagacggtcccgtaccccaggcctacgcagtcggactccgtttggaagtacgtcgggtcgggggcaaacgggggtaacccttggggtactacgttcggtacctaccgtcgtaaccgg

SEQ ID NO: 355397 - DNA, 553 bp, Homo sapiens
  misc_feature: GZ8MTXP02FH9MM.44.6.A06.1.454.CMB.2.raw
  modified_base (266)..(266): a, c, t, g, unknown or other
  misc_feature (266)..(266): n is a, c, g, or t
  modified_base (317)..(317): a, c, t, g, unknown or other
  misc_feature (317)..(317): n is a, c, g, or t
  modified_base (359)..(359): a, c, t, g, unknown or other
  misc_feature (359)..(359): n is a, c, g, or t
  modified_base (401)..(401): a, c, t, g, unknown or other
  misc_feature (401)..(401): n is a, c, g, or t
  modified_base (502)..(502): a, c, t, g, unknown or other
  misc_feature (502)..(502): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtncgccaggcccctggacaaggcttgagtggagtgggtggaatcattcccttntttttggctcactcacctacgcacgagacccgttccgggganagaacttacgattaccgcggacaacgtccacagacacagtcncatgaacaatgtagttctttagaaactccgacgacacggccgtatactactgtgacgaacgacggtcccgtacccagctcgcagtcggactcctttgacgntcgtcgggggcaacggggaaccctgggtactagttcggtccaccgtcaccg

SEQ ID NO: 355398 - DNA, 522 bp, Homo sapiens
  misc_feature: GZ8MTXP02FHW00.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctctttttggctcactcacctacgcacgagaccttccggggcagaattacgattaccgcggacaagtccacagacacagtctccatgacaatgagtctttgaaatccgacgacacggccgtctactactgtgcgagaggtccgtacccagctcgcatggagcctttgagatcgtgggggcaggggaaccctggtcattgtcacctcacg

SEQ ID NO: 355399 - DNA, 587 bp, Homo sapiens
  misc_feature: GZ8MTXP02JVHUE.44.6.A06.1.454.CMB.2.raw
  modified_base (267)..(267): a, c, t, g, unknown or other
  misc_feature (267)..(267): n is a, c, g, or t
  modified_base (316)..(316): a, c, t, g, unknown or other
  misc_feature (316)..(316): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtncgccaggcccctggacaagggcttgagtggagtggtgaatcatcccttnttttggctcactcacctacgcacgacgacccgtccggggacagaacttacgattaccggcggaacaacgtccacacgacacagtctaccatcgaacaatgtagttcttagaaacttcccgacgaccgaaccgggtcccttacttaacctacgtgtgaccggtaagacggttcccgaccccgagcctcgcagtcggactccgtttggaagtacgtcggtacgggggccacggggaacccgtgggtactacgttcggacctacccgtcaaccg

SEQ ID NO: 355400 - DNA, 567 bp, Homo sapiens
  misc_feature: GZ8MTXP02HHFP9.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtgcgccaggcccctggacaaggcttgagtggatggtggaatcatccctcttttggctcactcacctacgcacgagacccgttccggggcagaattacgattaccgcggacaagtccacacgacacacgtctccatagacaatgagttcttagaaactcgacgacacgccgtctactactgtcgacgacgaacggtcccgtaaccccaggtcctcggactagtggacgtcctttaggacgtacgtcggtcgggggaccacggggtaaccccgtgggtaccactttcggcctaaccgttcgaccg

SEQ ID NO: 355401 - DNA, 555 bp, Homo sapiens
  misc_feature: GZ8MTXP02H63MY.44.6.A06.1.454.CMB.2.raw
  modified_base (251)..(251): a, c, t, g, unknown or other
  misc_feature (251)..(251): n is a, c, g, or t
  modified_base (266)..(266): a, c, t, g, unknown or other
  misc_feature (266)..(266): n is a, c, g, or t
  modified_base (313)..(313): a, c, t, g, unknown or other
  misc_feature (313)..(313): n is a, c, g, or t
  modified_base (338)..(338): a, c, t, g, unknown or other
  misc_feature (338)..(338): n is a, c, g, or t
  modified_base (368)..(368): a, c, t, g, unknown or other
  misc_feature (368)..(368): n is a, c, g, or t
  modified_base (401)..(401): a, c, t, g, unknown or other
  misc_feature (401)..(401): n is a, c, g, or t
  modified_base (460)..(460): a, c, t, g, unknown or other
  misc_feature (460)..(460): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttgtcctcggtgaccctttcctgcacggcctctggaagtactaccagttccactacttanaccatcaactgggtncgccaggcccctggacaaggcttgagtggatgggtggatcatccctnttttggctcactcactacgctacgngaccgtccggggcagattacgattacccgngacaagtccacagacacagtctccatcgacaangtagtttcttagaaatccgacgacacggcgtctactatgtgcgagacggtcctaacccngctcgcaacgtggacgtcctttgacgtactcggtgggggaccacgggggtaaccccgttgggtacctacgttcgtaccgacccgttcgaacccgg

SEQ ID NO: 355402 - DNA, 542 bp, Homo sapiens
  misc_feature: GZ8MTXP02FUJLJ.44.6.A06.1.454.CMB.2.raw
  modified_base (318)..(318): a, c, t, g, unknown or other
  misc_feature (318)..(318): n is a, c, g, or t
  modified_base (482)..(482): a, c, t, g, unknown or other
  misc_feature (482)..(482): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggaccaaggggcttgagtggatgggtggaatcatccctnttttggctcactcacctacgcacgagaccttccggggcagtaatacgattaccgcggacaagtccacagacacagtctccatgacaatgattcttagaaatccgacgacacgccgtactactactgtgcgagacggtcccgtacccagacctcgcagtcggacncctttgagtactcgtcggggacacgggaacccgtgggtacacgttcgtcaccgtcaaccg

SEQ ID NO: 355403 - DNA, 545 bp, Homo sapiens
  misc_feature: GZ8MTXP02FPLX8.44.6.A06.1.454.CMB.2.raw
  modified_base (315)..(315): a, c, t, g, unknown or other
  misc_feature (315)..(315): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtactaccagttcccactacttatacccatcaactggtgcgccaggcccctggacaaggcttgagtggatgggtggaatcatccctnttttggctcactcacctacgcacgagacccgttccggggcagaacttacgattaccgcggtacaacgtccacagacacagtctcatgacatgattcttagaaactccgacgacacggccgtctactactgtgcgagacggtcccgtaccccagcctcgcagtcggacgtcctttagagtacgtcgtcgggggacacggggtaacccgtggtactagttcgcacctctacg

SEQ ID NO: 355404 - DNA, 588 bp, Homo sapiens
  misc_feature: GZ8MTXP02HJEGW.44.6.A06.1.454.CMB.2.raw
  modified_base (268)..(268): a, c, t, g, unknown or other
  misc_feature (268)..(268): n is a, c, g, or t
  modified_base (320)..(320): a, c, t, g, unknown or other
  misc_feature (320)..(320): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcctgcacggcctctggaagtactaccagttccactacttataccatcaactgggtnccgccacggcccctggacaaggcttgagtggagtgggtggaatcatcccttnttttggctcactcacctacgcacgagacccgttccggggacagtaattacgacttaccgcgaacaacgtccacacgacacagtccaccatgaacatgtagtttcttaggaaactccgacgacgacgccttactactacgtgtcggacgacggtacggtaccccgtacccgagcctacggctagttcggacgttccgttaggacgtacgtcgggtacggggaccgtaacggggaacccgtgggtaactcgttacgtccaccgttcaccg

SEQ ID NO: 355405 - DNA, 584 bp, Homo sapiens
  misc_feature: GZ8MTXP02HFGBO.44.6.A06.1.454.CMB.2.raw
  modified_base (366)..(366): a, c, t, g, unknown or other
  misc_feature (366)..(366): n is a, c, g, or t
  modified_base (409)..(409): a, c, t, g, unknown or other
  misc_feature (409)..(409): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctcgtggaagtactaccagttcccactacttatacccatcaactgggtgcgccacggcccctggacaagggcttgagtggagtgggtggaatcactcccttcgttttggctcactcacctacgcacgacgtaccgttccgggganagaattacgacttaccggcgacaacgtccacagacacagtccnccatgacatgattctagaactccgacgacgaccggctactactacgtgtgcgacgacgtcccgtacccagcctcgacacgtcggacgttccgtttaggacgtacgttcggtcgggggacctaacgggggtaaccccgttgggtaccgtacgtttcggacctacccgtacgtaccg

SEQ ID NO: 355406 - DNA, 559 bp, Homo sapiens
  misc_feature: GZ8MTXP02IGM8C.44.6.A06.1.454.CMB.2.raw
  modified_base (315)..(315): a, c, t, g, unknown or other
  misc_feature (315)..(315): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtactaccagttcccactacttatacccatcaactgggtgtgccaggcccctggacaagggcttgagtggatggtggatcatccctnttttggctcactcacctacgcacgagaccttccggggcagaattacgattaccgcgggacaagtaccacagacacagtctccatgacaatgagttctttagaaactccgacgacacggtccgtactactactgtgcgacgaggtcccgacccagctcgcagtcggacgtccgtttagacgtacgtcgtcgggggcacgggggtaaccctgggttacctagtttcggtacctaccttcgtaaccg

SEQ ID NO: 355407 - DNA, 573 bp, Homo sapiens
  misc_feature: GZ8MTXP02GJUO5.44.6.A06.1.454.CMB.2.raw
  modified_base (314)..(314): a, c, t, g, unknown or other
  misc_feature (314)..(314): n is a, c, g, or t
  modified_base (355)..(355): a, c, t, g, unknown or other
  misc_feature (355)..(355): n is a, c, g, or t
  modified_base (483)..(483): a, c, t, g, unknown or other
  misc_feature (483)..(483): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaaggcttgagtggatgggtgaatcatccctnttttggctcactcacctacgcacgagacccgttccgggganaagttacgtacttaccgacggacgaacgtaccacagacacacgtactaccatagacaatagtagttactttacgaaataccgacgacgacgaccgtctactactgtcgcgagacggtaccgtaccccngactcgcgagtggtacgtccgtttagtacgatacggtcgggggacgacgggaacccgtggttcgacgttcgtcctacctcgacgtacccg

SEQ ID NO: 355408 - DNA, 602 bp, Homo sapiens
  misc_feature: GZ8MTXP02HYSVH.44.6.A06.1.454.CMB.2.raw
  modified_base (512)..(512): a, c, t, g, unknown or other
  misc_feature (512)..(512): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggcctctggaagtactaccagttccactacttataccatcaactgggtgcgccaggcccctggacaaggcttgagtggagtgggtggaatcactcccttctttttggcttcactccacctacgaccacgacgacccgtttccggggacagtaaactttacgacgttacccggcgggtaacaaacgtccacagacacagtctccatgacaatgtagtttctttagaaactccgacgaacgacggtcccgttactactactggtcgacgacggacggtaccccgtacccagtccncgctacgtcggacgtccgtttagacgtacgtccggtacgggggccaacggggtaacccgttgggtacctagttgtaccaccttacgaccg

SEQ ID NO: 355409 - DNA, 555 bp, Homo sapiens
  misc_feature: GZ8MTXP02GER4I.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggcctctggaagtctaccggttccactacttataccatcaactggtgcgccaggcccctggacaagggcttgagtggatgggtgaatcatccctcttttggctcactcacctacgcacgagacttcccggggcagaattacgattaccgcgacaacgtccacagacacagtctaccatgacaatgagtttcttgaaatccgagtacacggccgtctactactgtcgcgagacgtccgtaccccagcctcgacagtcggacgtcctttagacgtactcggtcgggggacacggggtaacccgtgggtactacgttcggacctaccgtcacggtcccg

SEQ ID NO: 355410 - DNA, 571 bp, Homo sapiens
  misc_feature: GZ8MTXP02GZNO5.44.6.A06.1.454.CMB.2.raw
  modified_base (256)..(256): a, c, t, g, unknown or other
  misc_feature (256)..(256): n is a, c, g, or t
  modified_base (502)..(502): a, c, t, g, unknown or other
  misc_feature (502)..(502): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgccacggcctctggaagtactaccagttcccacttacttanaccatcaactggtgcgccaggcccctggacaaggcttgagtggagtgggtggatcatccctcttttggctcactcacctacgcacgagacccgtccggggcagaattacgattaccgcggacaagtccacagacacacgtctccatgacaatgtagtttcttagaaacgtccgacgacgaccggccgttactactactgtcggacgacgacggtcccgtacccgagcctcgacacgtacgggtacnccgtttgacgtactccggtagggggaccaacggggtaacccgtggtacacgttcgtaccactcgtaacg

SEQ ID NO: 355411 - DNA, 551 bp, Homo sapiens
  misc_feature: GZ8MTXP02IKF37.44.6.A06.1.454.CMB.2.raw
  modified_base (252)..(252): a, c, t, g, unknown or other
  misc_feature (252)..(252): n is a, c, g, or t
  modified_base (314)..(314): a, c, t, g, unknown or other
  misc_feature (314)..(314): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccattacttanaccatcaactgggtgcgccaggcccctggacaaggcttgagtggatgggtggatcatccctnttttggctcactcacctacgcacgagtaccgtccggggcagaattacgacttaccgcgacaagtccacagacacacgtctcatgacaatgtattctttagaaactccgacgacacgccgtactactactgtgacgagacggtcccgtacccaggctcgcagtcggactccgtttgacgtacgtcggtcgggggacacggggtaacccgtggtactacgttcgacctacctacgtacg

SEQ ID NO: 355412 - DNA, 541 bp, Homo sapiens
  misc_feature: GZ8MTXP02GP3HR.44.6.A06.1.454.CMB.2.raw
  modified_base (266)..(266): a, c, t, g, unknown or other
  misc_feature (266)..(266): n is a, c, g, or t
  modified_base (310)..(310): a, c, t, g, unknown or other
  misc_feature (310)..(310): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtncgcagccctggacaaggcttgagtggagtgggtgatcatccctnttttggctcactcactacgcacgagaccgtccggggcagattacgattaccgcggacaagtccacacgacacagtctacgatgacatgtagttcttagaactccgacgacacggccgtatactagtgtgcgacgcggtccctacccgagcctcgctacgtggacgtccgttgacgtcgtacggtcgggggactacgggaacccgtggactacttacgcctaccgtctaccg

SEQ ID NO: 355413 - DNA, 536 bp, Homo sapiens
  misc_feature: GZ8MTXP02HEOD9.44.6.A06.1.454.CMB.2.raw
  modified_base (315)..(315): a, c, t, g, unknown or other
  misc_feature (315)..(315): n is a, c, g, or t
  modified_base (388)..(388): a, c, t, g, unknown or other
  misc_feature (388)..(388): n is a, c, g, or t
tcagacagtatatacacgaccggtgctcgatttagatctactgacaaccacattcctcctctaaagaagcccctgggagcacagctcatcaccatggactggacctggaggttcctctttgtggtggcaacagcaacaggtgtccagtccctggtgcaactggtgcagtctgggactagaatgccgcaaccttggtcctcggtgaccctttcctgcacggcctctggaagtactaccagttccactacttataccatcaactggtgcgccaggcccctggacaagggcttgagtggatgggtggaatcatccctnttttggctcactcacctacgcacgagactcccggggcagatacgattaccgcgacagtccacagacacagtcnccatgacatgagttcttagaaactccgacgacgacgccgtctactactgtgcgagacggtccgtaccccagctcgcagtcggacgtcctttgacgtagtcggtcgggggacacgggaccctggtcagttcgtacaccgtcgacgtccc

SEQ ID NO: 355414 - DNA, 509 bp, Homo sapiens
  misc_feature: GZ8MTXP02G0EWE.44.6.A06.1.454.CMB.2.raw
  modified_base (265)..(265): a, c, t, g, unknown or other
  misc_feature (265)..(265): n is a, c, g, or t
  modified_base (310)..(310): a, c, t, g, unknown or other
  misc_feature (310)..(310): n is a, c, g, or t
  modified_base (376)..(376): a, c, t, g, unknown or other
  misc_feature (376)..(376): n is a, c, g, or t
  modified_base (441)..(441): a, c, t, g, unknown or other
  misc_feature (441)..(441): n is a, c, g, or t
  modified_base (465)..(465): a, c, t, g, unknown or other
  misc_feature (465)..(465): n is a, c, g, or t
  modified_base (474)..(474): a, c, t, g, unknown or other
  misc_feature (474)..(474): n is a, c, g, or t
  modified_base (506)..(506): a, c, t, g, unknown or other
  misc_feature (506)..(506): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctggtgaccctttcctgccacggcctctggaatactaccagttccactacttataccatcaactggtncgccaggcccctgacaaggcttgagtgatggtggaatcatccctnttttggctcactcacctacgcacgagaccttccggggcagattacgattacgcggacaagtccacngacacagtctccatgacaatgagtctttgaaatcgacgacacggccgtatactactgtcgcgagngtccgtacccagctcgcatcggancctttgagntctgggggcagggaacctggtcatgtcacctnacg

SEQ ID NO: 355415 - DNA, 570 bp, Homo sapiens
  misc_feature: GZ8MTXP02IPQK4.44.6.A06.1.454.CMB.2.raw
  modified_base (271)..(271): a, c, t, g, unknown or other
  misc_feature (271)..(271): n is a, c, g, or t
  modified_base (321)..(321): a, c, t, g, unknown or other
  misc_feature (321)..(321): n is a, c, g, or t
  modified_base (355)..(355): a, c, t, g, unknown or other
  misc_feature (355)..(355): n is a, c, g, or t
  modified_base (391)..(391): a, c, t, g, unknown or other
  misc_feature (391)..(391): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttctgccacggcctctggaacgtactaccagttcccacttacttataccatcaactgggtncgccacggccctggacaaggcttgagtggagtgggtgactcactcccttnttttgctcactcacctcgcacgcgccgtccgggnagtaatacgacttacgcggacacgtccacagacacngtctcatgaacagttgagtttctagtaaactccgacgacgacggcctactactcgtggtgacgtagaccggtccctacccgagcctcgacgtagttcggacttccgttagacgtacgttcggacgggggtccaacgggtaacccgtggtacgtacgttcggccctaccgttacgacccg

SEQ ID NO: 355416 - DNA, 561 bp, Homo sapiens
  misc_feature: GZ8MTXP02F8448.44.6.A06.1.454.CMB.2.raw
  modified_base (267)..(267): a, c, t, g, unknown or other
  misc_feature (267)..(267): n is a, c, g, or t
  modified_base (307)..(307): a, c, t, g, unknown or other
  misc_feature (307)..(307): n is a, c, g, or t
  modified_base (474)..(474): a, c, t, g, unknown or other
  misc_feature (474)..(474): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcctgcacggcctctggaagtactaccagttccactacttataccatcaactggtncgccaggccctggacaggctgagtgatggtgatcatcctnttttggctcactcacctacgcacgagacccgttccggggacagaacttacgacttaccgcggaacaagtccacagacacagtcaccatgacaatgtattctttagaaactccgacgacaccggtccgtactactactgtagcgacgacggtcccgtacccagctcgnacgtcggacgtcctttaggacgtacgtcgtcgggggaccaacggggtaacccgtgggtacctagtttcggtactaccctcgtaaccg

SEQ ID NO: 355417 - DNA, 548 bp, Homo sapiens
  misc_feature: GZ8MTXP02JDIUF.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctcttttggctcactcacctacgcacgacgaccttccggggcagattacgattaccgcgacaagtccacagacacagtctccatcgacatgagttcttagaaactccgacgacacggccgtctactactgtcgcgagacggtcccgtacccgagcctcgcagtcggacgtcctttgagtactcggtcgggggacacggggaaccccgtgggtaccacgttcgtccacctcgtacg

SEQ ID NO: 355418 - DNA, 558 bp, Homo sapiens
  misc_feature: GZ8MTXP02JGX06.44.6.A06.1.454.CMB.2.raw
  modified_base (310)..(310): a, c, t, g, unknown or other
  misc_feature (310)..(310): n is a, c, g, or t
  modified_base (334)..(334): a, c, t, g, unknown or other
  misc_feature (334)..(334): n is a, c, g, or t
  modified_base (466)..(466): a, c, t, g, unknown or other
  misc_feature (466)..(466): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtactaccagttccactacttataccatcaactggtgcgccaggcccctggacaaggcttgagtggatggtgaatcatcctnttttggctcactcactacgcacgngaccgttccgggacagaattacgattaccgcggtacaacgtccacagacacagtctaccatgacaatgagttcttagaaactcgacgacacggtccgtactactactgtcgacgagtacggtccctaacccngcctcgacacgtcggacgtccgttaggatacgtcggacgggggctaacggggaacccgttaggtacctagttcgtaccaccgttacgtaccg

SEQ ID NO: 355419 - DNA, 561 bp, Homo sapiens
  misc_feature: GZ8MTXP02H5JSV.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgccacggcctctggaagtactaccagttcccactacttataccattcaactgggtgcgccaggcccctggacaaggcttgagtggatgggtggatcatccctcttttggctcactcacctacgcacgagaccttccggggcagaattacgattaccgcggacagtccacagacacagtctccatgacaatgagtttcttagaatccgacgacacggccgtctactacgtgtgacgagacggtcccgtaccccgagtcctcgcagtcggacgttcctttagacgtacttcggacgggggtacacgggggtaaccctgggtacctacgttcggacctaccgttacaccg

SEQ ID NO: 355420 - DNA, 599 bp, Homo sapiens
  misc_feature: GZ8MTXP02HEANB.44.6.A06.1.454.CMB.2.raw
  modified_base (212)..(212): a, c, t, g, unknown or other
  misc_feature (212)..(212): n is a, c, g, or t
  modified_base (251)..(251): a, c, t, g, unknown or other
  misc_feature (251)..(251): n is a, c, g, or t
  modified_base (265)..(265): a, c, t, g, unknown or other
  misc_feature (265)..(265): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaccttggtcctcggtgaccctttcngcacggcctctggaagtactaccagttccacttacttanaccatcaactggtncgccacgcccctggacgaaggcttggagtggagtgggtggtaatcacgttcccttgttttcggctcgtacctcacctacgccacggacgtacccgttccggggacagtaacttacgacttaccggcgaacaagtaccacgagacacacgtcaccatagactaagtgtagtttcttagaaactccgacgtacacggtccgtctaacgttatgtcgacgacggtacggtcccgacccacgcctacgcgagttcggacgttcgttacgaggtacttcgggacggggccgtaccggggaaccgttggtacctacgttcgtccgtaaccgttccgaacg

SEQ ID NO: 355421 - DNA, 655 bp, Homo sapiens
  misc_feature: GZ8MTXP02IAWND.44.6.A06.1.454.CMB.2.raw
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcngcacggcctntggaatactacagttccatacttataccatcaactggtgcgccaggcccctggacaagggcttggagtggagtgggtggaatcgactcccttgttttggcttcactcacctacgcacgagacccgttccggggcaagaattacgaacgttaccgcggaacaacgtccaacgagacaacacgtcctaccaagtacgaactaaagtgttaacgttttcctttagaaaacgtcccggaacgaacgaccgggtcccttactaacgttaccgtggtacgacggaacggtaaccggtccccgtaaccccgaggtcctacggacctaaggttcggaacgttcccgtttaggaaacggtcgttccgggacgggggtaccaaacgggggtaacccccgttggggtaaccttacgttaccggttacccaccgtttacgaccg

SEQ ID NO: 355422 - DNA, 575 bp, Homo sapiens
  misc_feature: GZ8MTXP02F9D1O.44.6.A06.1.454.CMB.2.raw
  modified_base (322)..(322): a, c, t, g, unknown or other
  misc_feature (322)..(322): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgacccctttcctgccaccggcctctggaatacctaccagttccactacttataccatcaactgggtgccgccacggcccctggacaagggcttgagtggatgggtggaatcatccctnttttggctcactccacctacgcacgacgaccgttccggggcagaattacgattaccgcggacaagtccacagacacagtctccatgaacatgtagttcttagaaactccgaacgacaccggccgtactaactactgtagcgaacgcggtacccgtacccagtctcgctagtcgggactccgttgagtacgtcggtcgggggaccaacggggtaaccccgtgggtacctacgttcgtacctaacctcgtaaccg

SEQ ID NO: 355423 - DNA, 539 bp, Homo sapiens
  misc_feature: GZ8MTXP02JSORU.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggatgggtggaatcatccctcttttggctcactcacctacgcacgagacccgttccggggcagaattacgacttaccgcggacaagtccacagacacagtctccatgacatgagttcttagaatccgacgacacggccgtctactactgtcgacgagacggtccgtacccagcctcgcagtcggacgtccttgagtacgtcgtagggggcacggggaaccctggtctagttcgccaccgtcacg

SEQ ID NO: 355424 - DNA, 573 bp, Homo sapiens
  misc_feature: GZ8MTXP02JPTYU.44.6.A06.1.454.CMB.2.raw
  modified_base (316)..(316): a, c, t, g, unknown or other
  misc_feature (316)..(316): n is a, c, g, or t
  modified_base (394)..(394): a, c, t, g, unknown or other
  misc_feature (394)..(394): n is a, c, g, or t
  modified_base (482)..(482): a, c, t, g, unknown or other
  misc_feature (482)..(482): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccacggcccctggacaagggcttgagtggatgggtgaatcatccctnttttggctcactcacctacgcacgagacgtttccggggacagaacttacgacttaccgcgaacaagtccacagacacncgtactccatgacaagtcgtatttcgttagaaactcccgacgaccgacggccgtactactacgtgtcgcgagacggtacccgtacccnggcctcgcacgtcggacgtccttggacgtacgtcggtacgggggccgtaggggtaacccgtgggttacctgttcgtcctaccgtctaaccg

SEQ ID NO: 355425 - DNA, 571 bp, Homo sapiens
  misc_feature: GZ8MTXP02H1GDJ.44.6.A06.1.454.CMB.2.raw
  modified_base (267)..(267): a, c, t, g, unknown or other
  misc_feature (267)..(267): n is a, c, g, or t
  modified_base (316)..(316): a, c, t, g, unknown or other
  misc_feature (316)..(316): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccacttacttataccatcaactggtncgccaggcccctggacaaggcttgagtggatgggtggaatcactccctnttttggctcactcacctacgccacgagtaccgttccggggccagtaacttacgacttaccgcggacaagtcccaacagacacagtcctcatgaacaatgagtttctttagaaatccgacgacgaacggcccgtactactacgtgtcgcgaacgacggtcccgtacccagcctcgcgaagtcggactcctttggacgtactccggtgggggaccaacggggaaccccgttgggacctagttgtccaccttcgaccg

SEQ ID NO: 355426 - DNA, 571 bp, Homo sapiens
  misc_feature: GZ8MTXP02IVGAT.44.6.A06.1.454.CMB.2.raw
  modified_base (322)..(322): a, c, t, g, unknown or other
  misc_feature (322)..(322): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgccacggcctctggaagtactaccagttcccacttacttataccatcaactgggtgcgccacggcccctggacaaggcttgagtggagtggtggaatcactcccttnttttggctcactcacctacgcacgacgaccgtccggggcagaacttacgacttaccgcggacaacgtccacagacacagtccacatgacatgtattcttagaaatccgacgacacggccttactactactgtgacgagacggtcccgtaccacgcctcgctagtcggacgtcgtttacgagtactcgggtacgggggaccgtaacggggaacccgttgggtactacgttcgtaccctaccgtactaccg

SEQ ID NO: 355427 - DNA, 533 bp, Homo sapiens
  misc_feature: GZ8MTXP02JXNGD.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgccacggcctctggaagtactaccagttccactacttataccatcaactgggtgcgccaggcccctggacaaggcttgagtggatgggtggaatcatccctcttttggctcactcacctacgcacgagaccttccggggcagaattacgattaccgcgacaagtccacagacacagtctccatgacaatgattcttagaaatccgacgacacggccgtctactactgtgcgagacggtcccgtaccccagcctcgcatcggactcctttgacgatcgtcgggggcacggggaaccctgggtaccagttcgcacctcacg

SEQ ID NO: 355428 - DNA, 594 bp, Homo sapiens
  misc_feature: GZ8MTXP02HH7EJ.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcctgcacggcctcgtggaacgtactaccagttccacttacttataccatacaacgtgggtgcgccgacggccccgtggacgaagggcttggagtggagtggggtggaatcactcccttgttttggctcactccacctacgcacgacgacccgttccggggacacgtaacttacgacttaccggcggaacaacgtccacacgacacacgtctccaatcgaacaatgtagttcttagaaactccggacacgaccggccgtactactatgtagcgacgacggtcccgtacccgagcctcgacagtcggacgtccgtttaggacgtacgtcgggtcggggacgacgggtaacccgtggtaccgtagttcgtccgtacctacgaccg

SEQ ID NO: 355429 - DNA, 551 bp, Homo sapiens
  misc_feature: GZ8MTXP02JQMQJ.44.6.A06.1.454.CMB.2.raw
  modified_base (310)..(310): a, c, t, g, unknown or other
  misc_feature (310)..(310): n is a, c, g, or t
  modified_base (348)..(348): a, c, t, g, unknown or other
  misc_feature (348)..(348): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtactaccggttcactacttataccatcaactggtgcgccaggcccctggacaagggcttgagtggatgggtgatcatcctnttttggctcactcacctacgcacgagacttcccggggnagatacgattaccgcgcaacgtcacagacacagtctaccatgacaatgagttactttagaaatccgacgacaccggcctcgtactacgtgtggcgagacggtccgtacccacgctcgacagtggacgtcctttgagtacgtcggtcgggggacacgggaacccgtggggtacctagttcggtacctacccgtacgacgtcccg

SEQ ID NO: 355430 - DNA, 546 bp, Homo sapiens
  misc_feature: GZ8MTXP02JZRID.44.6.A06.1.454.CMB.2.raw
  modified_base (268)..(268): a, c, t, g, unknown or other
  misc_feature (268)..(268): n is a, c, g, or t
  modified_base (318)..(318): a, c, t, g, unknown or other
  misc_feature (318)..(318): n is a, c, g, or t
  modified_base (387)..(387): a, c, t, g, unknown or other
  misc_feature (387)..(387): n is a, c, g, or t
  modified_base (427)..(427): a, c, t, g, unknown or other
  misc_feature (427)..(427): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtacctcggtgaccctttcctgcacggcctctggaagtactaccagttccactacttataccatcaactgggtncgccaggcccctggacaagggcttgagtggatgggtggaatcatcccttnttttggctcactcacctacgcacgagaccgttccggggcagaacttacgattaccgcggacaagtccanagacacagtctccatgacaatgagttcttagaaatccganacacggtcctactactactgtcgcgacgaggtcccgtaccccagcctcgcaatcggacgtcctttagacgtactcgcgggggacacggggaaccctgggtccagtttcgcaccctcacg

SEQ ID NO: 355431 - DNA, 635 bp, Homo sapiens
  misc_feature: GZ8MTXP02J30PR.44.6.A06.1.454.CMB.2.raw
  modified_base (276)..(276): a, c, t, g, unknown or other
  misc_feature (276)..(276): n is a, c, g, or t
  modified_base (327)..(327): a, c, t, g, unknown or other
  misc_feature (327)..(327): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgacccctttctgccacggcctcgtggaacgtactacccagttccacttacttatacccgatcaacgtgggtnccgccaggcccctggacaaggcttggagtggatgggtaggatcactccttnttttggctcactcacctacgcacgacgtaccgtccggggacagaacttacgacgttaccgcggtaacaacgtccacgagacactacgtctaccatcgaactaaagtgtaacggtttctttaagaaacttaccccggacgaccgacgggtccttactacgtacgttgacggcgacggaccggttacccgtaccccaggttccctacgacgtagtacggacgttcgttacggacgtacggtccgggtacggggtaccgtaaccgggtaaccgttcggtaccttacgttccgtaccctaccgtacgtaccg

SEQ ID NO: 355432 - DNA, 643 bp, Homo sapiens
  misc_feature: GZ8MTXP02F7KD7.44.6.A06.1.454.CMB.2.raw
  modified_base (316)..(316): a, c, t, g, unknown or other
  misc_feature (316)..(316): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttctgcacggcctctggaagtactaccagttccactacttataccatcaactgggtgcgccacggcccctggacaaggcttgagtggatgggtggaatcatccctnttttggctcactcactacgcacgacgacccgttccggggacagtaaacttacgaacttacccggcgggaacaaacggtccaacacgacaacacgtacctaccatagaacaagtgtaagtttcgtttagaaaacgtcccgaacgaccgaccggcccgttactaaccgtactacggttgacggacgtacggtaccccgtaaccccgacgtctaccgacgaacgtcggggaacgtcccgttttaggaacgtacgttcgggtacggggggaccgaaacgggggtaaccccgttggtacgttacgtttcgttacccgaaccttcctaaccgg

SEQ ID NO: 355433 - DNA, 595 bp, Homo sapiens
  misc_feature: GZ8MTXP02FRFZ9.44.6.A06.1.454.CMB.2.raw
  modified_base (318)..(318): a, c, t, g, unknown or other
  misc_feature (318)..(318): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggagtgggtggaatcatcccttnttttggctcactccacctacgcacgacgtacccgttccggggacagtaacttacgactttacccggcggaaccaaacgtcccaacagacacagtcctaccatgaacaatgacgttctttagaaactccgacgacaccggtccgtctactactgtgcgtacgacggtcccgacccgagctcggcagtcggacgtccgtttaggagtacgttcggtacgggggacctaacgggggtaaccccttggggtactacgtttcggtacctacctacgtaaccg

SEQ ID NO: 355434 - DNA, 561 bp, Homo sapiens
  misc_feature: GZ8MTXP02G5FHT.44.6.A06.1.454.CMB.2.raw
  modified_base (315)..(315): a, c, t, g, unknown or other
  misc_feature (315)..(315): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggcctctggaagtactaccagttccactacttataccatcaactgggtgcgccaggcccctggacaaggcttgagtggatgggtgaatcatccctnttttggctcactcacctacgcacgagacccgttccggggcagaatacgattaccgcgacaagtccacagacacacgtctccatcgacaatgtagtttcttagaaactccgacgaccaacggtccgtactactactgtgacgagacggtcccgtacccagtcctacgctagtcggacgtcctttgagtacgtccggtgggggacacggggaacccgtggtacctacgttcgtaccaccgttacaccg

SEQ ID NO: 355435 - DNA, 573 bp, Homo sapiens
  misc_feature: GZ8MTXP02HPYFK.44.6.A06.1.454.CMB.2.raw
  modified_base (214)..(214): a, c, t, g, unknown or other
  misc_feature (214)..(214): n is a, c, g, or t
  modified_base (266)..(266): a, c, t, g, unknown or other
  misc_feature (266)..(266): n is a, c, g, or t
  modified_base (312)..(312): a, c, t, g, unknown or other
  misc_feature (312)..(312): n is a, c, g, or t
  modified_base (450)..(450): a, c, t, g, unknown or other
  misc_feature (450)..(450): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttccngcacggcctctggaagtactaccagttccactacttataccatcaactggtncgccaggcccctggacaaggcttgagtggatgggtgatcatccctnttttggctcactcacctacgcacgagacccgttccggggcagaattacgacttacgcggaacaagtccacagacacagtctccatgaacaagtgagtttctttagaaactccgacgacaccgggccttactacttacngtgcgagacggtccctacccgagctcgacagtcggacgtcctttagagtacgtcggtcgggggaccaacggggtaaccccgttggggtacctaacggttcgtaccctaaccgtttcgaaaccg

SEQ ID NO: 355436 - DNA, 567 bp, Homo sapiens
  misc_feature: GZ8MTXP02JH235.44.6.A06.1.454.CMB.2.raw
  modified_base (320)..(320): a, c, t, g, unknown or other
  misc_feature (320)..(320): n is a, c, g, or t
  modified_base (405)..(405): a, c, t, g, unknown or other
  misc_feature (405)..(405): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgacccctttcctgcacggcctcgtggaagtacctaccagttccactacttataccatcaactgggtgcgccacggccctggacaagggcttgagtggagtgggtgatcatcccttnttttggctcactcacctacgcacgacgacccgttccgggcagaacttacgacttaccgcggacaacgtcccacagacacagtccncatgacatgtattcttagaactcgacgacacggcgtactactacgtgtgcgagacgtcccgtacccagcctcgcagtcggactccgttagacgtatccgggtacgggggactacggggtaacccgtggttaccgtacgttacggtctaacccgtcgtaaccg

SEQ ID NO: 355437 - DNA, 733 bp, Homo sapiens
  misc_feature: GZ8MTXP02HE7IN.44.6.A06.1.454.CMB.2.raw
  modified_base (225)..(225): a, c, t, g, unknown or other
  misc_feature (225)..(225): n is a, c, g, or t
  modified_base (253)..(253): a, c, t, g, unknown or other
  misc_feature (253)..(253): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtcgtgggactagaatgccgcaaccgttggtcctcggtgaccctttctgcacggcctntggaagtactaccagttccactacttanaccatcaacgtggtcgcgccacggcccctggacaagggtcttggagtggagtgggtaggaatcgtacgttcccttcgtttttcggccttaccgtaccttccgtaccctacgaccgaacggtacgtaccccgttcccggggacgtaaagtaaacgttacgaacgttaacccggccggtaaacgtaaacgtcccaaacgaacgaaccaaccgtaacgtcccttacccaatacgaaactaacgttagtacgttttacttaaggaaacgttacccggaaccgtaaaccgtacccgggtaccgttactaaccgttacgtcggttacgacggaacggtaccgggtaccccgtaacccgtacgtacccgttccgaccgtagtacggtacgtcccgttttaggaacggtcggttacggtcgggggaaccgtaacggggtaacccgttcgggtaccgttacgttcgtaccggtacctaccggtaacccg

SEQ ID NO: 355438 - DNA, 567 bp, Homo sapiens
  misc_feature: GZ8MTXP02GKDES.44.6.A06.1.454.CMB.2.raw
  modified_base (204)..(204): a, c, t, g, unknown or other
  misc_feature (204)..(204): n is a, c, g, or t
  modified_base (267)..(267): a, c, t, g, unknown or other
  misc_feature (267)..(267): n is a, c, g, or t
  modified_base (315)..(315): a, c, t, g, unknown or other
  misc_feature (315)..(315): n is a, c, g, or t
  modified_base (352)..(352): a, c, t, g, unknown or other
  misc_feature (352)..(352): n is a, c, g, or t
  modified_base (449)..(449): a, c, t, g, unknown or other
  misc_feature (449)..(449): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtnaccctttcctgccacggcctctggaatactaccagttccactacttataccatcaactgggtncgccaggcccctggacagggcttgagtggatggtggaatcatcccttnttttggctcactcacctacgcacgagacctccggggnagaattacgattaccgcgacaacgtccacacgacacacgtactccatagacaatgtagttctttagaaactccgaacgacaccggccgtactactangtgacgagacggtcccgtacccagctcgcagtcggacgtcctttaggagtacgtcgggtacgggggccgaacggggtaacccctggggtactacgttcggtacctaccgtcgtaaccg

SEQ ID NO: 355439 - DNA, 617 bp, Homo sapiens
  misc_feature: GZ8MTXP02IHBOJ.44.6.A06.1.454.CMB.2.raw
  modified_base (265)..(265): a, c, t, g, unknown or other
  misc_feature (265)..(265): n is a, c, g, or t
tcagacagtatatacacgaccggtgctcgatttagatctactgacaaccacattcctcctctaaagaagccccctgggagcacagctcatcaccatggactggacctggaggttcctctttgtggtggcagcagcaacaggtgtccagtccctggtgcaactggtgcagtctgggactagaatgccgcaaccttggtcctcggtgacccttctgcacggcctctggaagtctaccagttccacttacttataccatcaactggtncgccaggcccctggacaaggcttgagtggagtgggtggaatcacttccctctttttcggctcactcacctacgcacgagacccgttccgggcagaacttacgacttaccgcggacaagtcccaacgagacacgacgtcctaccatcgaacaaatgtagtttctttagaaattcccgacgaccgaccgggtccttacttactacgttgtcggacgacgacggttcccgtacccgacgtctcgcgtagtcggacgtccgtttgaaacggtcgttcggacgggggtacctaacgggggtaaacccccgttggggttaaccctagtttccggtaccctaaccggttactaacccgg

SEQ ID NO: 355440 - DNA, 588 bp, Homo sapiens
  misc_feature: GZ8MTXP02G5G92.44.6.A06.1.454.CMB.2.raw
  modified_base (251)..(251): a, c, t, g, unknown or other
  misc_feature (251)..(251): n is a, c, g, or t
  modified_base (315)..(315): a, c, t, g, unknown or other
  misc_feature (315)..(315): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtactaccagttccactacttanaccatcaactgggtgcgccacggcccctggacaaggcttgagtggagtgggtggatcatccctnttttggctcactcacctacgcacgagacccgttccggggacagtaacttacgattaccggcgacaagtccacacgacacacgtctcatcgaacatgtattcttagaaactccgacgacacggccgttactactactgtcgacgagacggtcccgtacccagcctacgcacgtcggacgtccgtttagacgtacgttccgggacgggggacctaacgggggtaaccccgttgggtacctaacggtttcggttacccacccgttacgtaacccgg

SEQ ID NO: 355441 - DNA, 595 bp, Homo sapiens
  misc_feature: GZ8MTXP02GNXDS.44.6.A06.1.454.CMB.2.raw
  modified_base (313)..(313): a, c, t, g, unknown or other
  misc_feature (313)..(313): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccccttttctgcacggcctctggaagtactaccagttccactacttataccatcaactgggtgcgccagcccctggacaggcttgagtggatgggtgaatcatccctnttttggctcactcacctacgcacgagacccgttccggggcagaacttacgacttaccgcggaacaacgtccaacagacacacgtctccgatgaactaatgtagtttctttagaaactccgacgacgaccggtccgtactactacgtcggtacgacgtacggacggtccccgtacccgaggtcctccggctaacgtcgggacgtccgtttggacggtacgttcgggtacggggcgaacggggtaaccccgtgggtactacgttcgacctaccgtactaaccgg

SEQ ID NO: 355442 - DNA, 529 bp, Homo sapiens
  misc_feature: GZ8MTXP02JF0HZ.44.6.A06.1.454.CMB.2.raw
  modified_base (270)..(270): a, c, t, g, unknown or other
  misc_feature (270)..(270): n is a, c, g, or t
  modified_base (319)..(319): a, c, t, g, unknown or other
  misc_feature (319)..(319): n is a, c, g, or t
  modified_base (479)..(479): a, c, t, g, unknown or other
  misc_feature (479)..(479): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaacccttggtcctcggtgaccccttttcctgcacggcctctggaagtactaccagttccactacttataccatcaactgggtncgccaggcccctggacaagggcttgagtggatgggtggaatcatccctnttttggctcactcacctacgcacgagaccttccggggcagaattacgattaccgcggacaagtccacagacacagtctccatgacatgagttcttagaaatccgacgacacggccgtactactactgtgccgagacggtccgtacccagctcgcatggancctttgagactcgtcgggggcagggaaccctggtacagttgcacctcacg

SEQ ID NO: 355443 - DNA, 559 bp, Homo sapiens
  misc_feature: GZ8MTXP02GDCD2.44.6.A06.1.454.CMB.2.raw
  modified_base (305)..(305): a, c, t, g, unknown or other
  misc_feature (305)..(305): n is a, c, g, or t
  modified_base (317)..(317): a, c, t, g, unknown or other
  misc_feature (317)..(317): n is a, c, g, or t
  modified_base (485)..(485): a, c, t, g, unknown or other
  misc_feature (485)..(485): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgacccctttcctgcacggcctctggaagtactaccagttccactacttataccatcaacgtgggtcgcgccaggcccctggacaaggcttgagtgagtggngaatcatccctnttttgctcactctacctacgcacgagacccgttccggggacagaattacgattaccggcgaacaacgtccacagacacacgtctccatcgaacaatgtagttcttagaaactccgacgacgacgccgtctactactgtagcgagcggtccctaccccgagcctcgacngtcggacgttctttcgaggtacttcggcgggggaccacgggaaccgtgtactacgttcgacaccgtacgtaccg

SEQ ID NO: 355444 - DNA, 580 bp, Homo sapiens
  misc_feature: GZ8MTXP02G3BTT.44.6.A06.1.454.CMB.2.raw
  modified_base (366)..(366): a, c, t, g, unknown or other
  misc_feature (366)..(366): n is a, c, g, or t
  modified_base (467)..(467): a, c, t, g, unknown or other
  misc_feature (467)..(467): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgccacggcctcgtggaacgtactaccagttccacttacttataccatcaactgggtgcgccacggcccctggacaagggcttgagtggagtgggtggaatcactcccttcttttggctcactcacctacgcacgacgtacccgtccggggnagaacttacgacgttaccgcggtaacaacgtccacagacacacgtctaccatacgacaatgtagttcttagaaactccgacgacacggccgtactactacngtgcgagtcgtcccgtacccagctcgcagtcggacgtccgttagacgtactcgggtacggggaccaacggggtaaccctggggttactacgttcgtcctaccgtcgtaaccgg

SEQ ID NO: 355445 - DNA, 565 bp, Homo sapiens
  misc_feature: GZ8MTXP02GAOTS.44.6.A06.1.454.CMB.2.raw
  modified_base (267)..(267): a, c, t, g, unknown or other
  misc_feature (267)..(267): n is a, c, g, or t
  modified_base (319)..(319): a, c, t, g, unknown or other
  misc_feature (319)..(319): n is a, c, g, or t
  modified_base (344)..(344): a, c, t, g, unknown or other
  misc_feature (344)..(344): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtncgccacggcccctggacaagggcttgagtggatgggtggaatcattcccttnttttggctcactcacctacgcacgngacccgttccggggcagaattacgattaccgcggacaacgtccacagacacagtctccatgaacaatgtagttctttagaaactccgacgaccgacggtccgtctactacgtgtgacgacggacggtcccgtaccccgagccctcgcatcggagtcctttgaagtctcggtacggggggcaacgggggtaaccctgggtacctagttcgtaccacctcacg

SEQ ID NO: 355446 - DNA, 552 bp, Homo sapiens
  misc_feature: GZ8MTXP02FQPSV.44.6.A06.1.454.CMB.2.raw
  modified_base (301)..(301): a, c, t, g, unknown or other
  misc_feature (301)..(301): n is a, c, g, or t
  modified_base (313)..(313): a, c, t, g, unknown or other
  misc_feature (313)..(313): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtctaccagttccactacttataccatcaactgggtgcgccaggcccctggacaagggcttgagtggatggnggatcatccctnttttggctcactcacctacgcacgagcccttccggggcagaattacgattaccgcggacaagtccacagacacagtctcatgacaatgattctttagaaactccgacgacacggccgtctactactagtgcgagacggtcccgtaccccgagctcgcagtcggacgtcctttcggagtacgtcgtcgggggcaacggggaaccccgtgggtcctagttcgtacctaacccgtcgtaccg

SEQ ID NO: 355447 - DNA, 574 bp, Homo sapiens
  misc_feature: GZ8MTXP02GAAWG.44.6.A06.1.454.CMB.2.raw
  modified_base (268)..(268): a, c, t, g, unknown or other
  misc_feature (268)..(268): n is a, c, g, or t
  modified_base (319)..(319): a, c, t, g, unknown or other
  misc_feature (319)..(319): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttctgcacggcctcgtggaagtactaccagttccactacttataccatcaactgggtncgccaggcccctggacaaggcttgagtggagtgggtggaatcactcccttnttttcggctcactcacctacgcacgacgtaccgtccggggacagaattacgacttaccgcggacaagtccacagacacagtctcatgacatgatcttagaactcgacgacacggcccgttatactactgtacgacgacgtacggtccctacccgagtcctacgctagtacggacgtccgtttagacgtacgtcggtacgggggcgaacgggtaaccccgttgggtactacgttcgtacccgtacctacgtacccg

SEQ ID NO: 355448 - DNA, 576 bp, Homo sapiens
  misc_feature: GZ8MTXP02JQEEV.44.6.A06.1.454.CMB.2.raw
  modified_base (267)..(267): a, c, t, g, unknown or other
  misc_feature (267)..(267): n is a, c, g, or t
  modified_base (315)..(315): a, c, t, g, unknown or other
  misc_feature (315)..(315): n is a, c, g, or t
  modified_base (386)..(386): a, c, t, g, unknown or other
  misc_feature (386)..(386): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtncgccacggcccctggacaagggcttgagtggatgggtgatcatccctnttttggctcactcacctacgcacgacgaccgttccggggcagaattacgattaccgcggacaagtccacanacacagtcctaccatgaacatgatttcttagaaactccgacgacacggccgtctactacgtgtcgcgagacggtcccgtacccagcctcgcacgtcggacgtccgtttggaacgtacgtccgggtacgggggaccgaacgggggaaccccgttggggtacctaacgttcgtaccgaccgttacgtacccg

SEQ ID NO: 355449 - DNA, 635 bp, Homo sapiens
  misc_feature: GZ8MTXP02H2VJZ.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgccacggcctctggaacgtactaccagttccacttacttacaccatcaactgggtcgcgccgacggcccctaggacaacgggcttgaggtggagtgggtaggaactcacgtccctttcgttttggccttacgtacttccacctacgccacggagtaccccgtccggggactagaacttacgaacttacccgcgaacaaacgtcccaacaagaaccacacgtcctaccatacgaacaaagtgtacgtttacgtttacgaaacgtccgaacgaccgaccggtccgtactacttactcgtcggtacgacgaccggtacccgtaccccgagcctacgcgacgtcggacgtccgtttagacgtagtaccggtacgggggacgaacggggaacccgtcgggtctacgttcgaccgtacctcgaccg

SEQ ID NO: 355450 - DNA, 829 bp, Homo sapiens
  misc_feature: GZ8MTXP02H1SJC.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaacgtggtgcagtcgtgggactagaatcgccgactaaccgttggtcctcggtcgtacccctttctgccgacggtcctcgtaggaacgtacctacctagttacccacttacttactaccatacaacgtgggtcgccgccgacggccccgtggaacgaagggtcgttggaggtggagtgggtaggtaactcctacctttccccgtttcgtttttacggcctttacctaccttaccaacccgtaccgaccgtaaccggtaacgtaccccggttacccggggactaacggtaaacgtttaaccggaacgtttaaccccgggaccggtaaaccgtaaacggtacccccgaaacgaacgaaccaaacctaccgttaccctaccctaagtacgtaaacctaaagttagttaacgttttacgttaaacgtaaaaccgttccccggaaaccgtaacccgtaaccccggttacccgttaaccgttaaccgtttaacgtcgggtaacggaccgggtaaaccggtacccgggttacccccgttaaccccgacgtcccgttaccggacgtaacggttcgggtaacggtttcccggtttaaggaaccggttacggttccgggggtacgggggaaccgaaccggggttaaccccgtggtaccgttagtcggtacgtacgtccgtacg

SEQ ID NO: 355451 - DNA, 672 bp, Homo sapiens
  misc_feature: GZ8MTXP02HGVMM.44.6.A06.1.454.CMB.2.raw
  modified_base (347)..(347): a, c, t, g, unknown or other
  misc_feature (347)..(347): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttcctgcacggcctctggaagtactaccagttccacttacttataccatcaactggtgcgccacggccctggacaaggcttgagtggagtgggtggatcactcccttcgttttggctcgtactcacctacgcacgngacccgttccgggcagtaacttacgacgttaccgcggtacaagtccacacgaacacgacgtcctccgaattacgaactaagttcgtaagttttcgttaagaaaacgttcccgaacgaccgtacccgggtccttacctaaccttacgtggtacggaccggtacggccgggttaccccgtaaccccgacggtcccgtaccgacgacgttcgggaccgttcccgttttaggaacggttccgttacggggtacgggggaccgtaaaccgggggtaaccccgttgggtacccgtttaaggttccggtacccgtaacccttcggtaacccg

SEQ ID NO: 355452 - DNA, 624 bp, Homo sapiens
  misc_feature: GZ8MTXP02GJGS9.44.6.A06.1.454.CMB.2.raw
  modified_base (408)..(408): a, c, t, g, unknown or other
  misc_feature (408)..(408): n is a, c, g, or t
  modified_base (410)..(410): a, c, t, g, unknown or other
  misc_feature (410)..(410): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccccttttcctgccaccggccttcgtggaaacgtacctacccagttcccaactacttaatacccatcaacgtgggtgcgccacggcccctggacaaggcttgagtggatgggtgaatcatcccttcttttggctcactcacctacgccagacgaccccgttccggggacagtaacttacgacttaccgcggacaacgtccananacacagtcctacatgaactaatgtagtttactttagaaactccgaacgacctaccggcccgtactacctacgttcgtggaccgacggtaccggttccccgacccgtacgccgtcgctaacgtcgggacttccgtttacggaagtcgttccgggtacgggggcaaaccggggtaacccgttgggtacctagtttccgtacctaaccgtcgtaacg

SEQ ID NO: 355453 - DNA, 565 bp, Homo sapiens
  misc_feature: GZ8MTXP02FQBY9.44.6.A06.1.454.CMB.2.raw
  modified_base (319)..(319): a, c, t, g, unknown or other
  misc_feature (319)..(319): n is a, c, g, or t
  modified_base (359)..(359): a, c, t, g, unknown or other
  misc_feature (359)..(359): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttggagtggagtgggtggaatcattccctnttttggctcactcacctacgcacgagaccgttccgggganaagtactataccgacgacgaactacacacgacacacgtactccatagacaatgtagtttcttacgtaaataccgaacgaccgacggaccgtcctactactgtgcgagacgtccgtacccacgctcgcagtcgacgtaccgttgacgacgtcggtcggggtacgacgggtaccgtcgtcgtacgttcgtaccacctcgacgtacccg

SEQ ID NO: 355454 - DNA, 621 bp, Homo sapiens
  misc_feature: GZ8MTXP02HFF4V.44.6.A06.1.454.CMB.2.raw
  modified_base (214)..(214): a, c, t, g, unknown or other
  misc_feature (214)..(214): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcngcacggcctcgtggaagtacctacagttcccacttacttataccatcaactggtgcgccacggccctggacaaggcttgagtggagtgggtggaatctactccctgtttttcgctcactcacctcgcacgacgaccgttccgggcagtaattacgacttacgcggacaacgtccaacacgacacagtccactactgaacaattgtaatttcgtttagaaactaccgacgacctaacggccttacctacttacgtgtacgtacgagtaccggtaccccgtaacccgagtcctccgacgtacgtacggacgttccgtttacgggactaggtccgggttacgggggacctaaccgggggtaaccccgttggtaccgtaacgttttcggaccctaacccgtcgttaacccg

SEQ ID NO: 355455 - DNA, 553 bp, Homo sapiens
  misc_feature: GZ8MTXP02FRBIX.44.6.A06.1.454.CMB.2.raw
  modified_base (266)..(266): a, c, t, g, unknown or other
  misc_feature (266)..(266): n is a, c, g, or t
  modified_base (314)..(314): a, c, t, g, unknown or other
  misc_feature (314)..(314): n is a, c, g, or t
  modified_base (370)..(370): a, c, t, g, unknown or other
  misc_feature (370)..(370): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtncgccaggcccctggacaaggcttgagtggatgggtgaatcatcccttnttttggctcactcacctacgcacgagaccttccggggcagaattacgacttaccgnggacaagtccacagacacagtctaccatgacaatgagttctttagaactccgaacgacacggcctatactactgtagccgagtacggtcccgtacccagcctacgctaagtcggacgtccgtttagagtacgttcggcgggggacacggggtaacccgtggtaccagttcgtaccacgtcacg

SEQ ID NO: 355456 - DNA, 557 bp, Homo sapiens
  misc_feature: GZ8MTXP02HXCOP.44.6.A06.1.454.CMB.2.raw
  modified_base (186)..(186): a, c, t, g, unknown or other
  misc_feature (186)..(186): n is a, c, g, or t
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (234)..(234): a, c, t, g, unknown or other
  misc_feature (234)..(234): n is a, c, g, or t
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
  modified_base (263)..(263): a, c, t, g, unknown or other
  misc_feature (263)..(263): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (401)..(401): a, c, t, g, unknown or other
  misc_feature (401)..(401): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagatgccgnaaccttgtcctggtnaccctttcngcacggcctctggaagtactaccngttccatacttanaccatcaactggtncnccagccctggacaggctgagtgatggtgatcatcctcttttggctcacttcacctagcacgagacccttcggggcagattacgattacgcgaacaagtccanagacangcctcatgacatgattcttagaaatccganaacacggcctctactactgcgacgagtaccggtccgtaaccccgagccttccgacaagttggacggtccctttaggaaagtacttccgggggtacgggggtaaccgaccgggtaacccgttggtacctacggttaccgtaccctaccgtacgtccg

SEQ ID NO: 355457 - DNA, 616 bp, Homo sapiens
  misc_feature: GZ8MTXP02IGGSU.44.6.A06.1.454.CMB.2.raw
  modified_base (321)..(321): a, c, t, g, unknown or other
  misc_feature (321)..(321): n is a, c, g, or t
tcagacagtatatacacgaccggtgctcgatttagatctactgacaaccacattcctcctctaaagaagccccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcaccggcctcgtggaagtacctaccagttccacttacttataccatcaacgtggtgcgccacggcccctggacaaggctgagtggagtgggtgaatcatcccttnttttggctcactcacctacgcacgacgtacccgttccggggacagtaacttacgacttacccggcggaacaacggtccacgacgacacacgtcctcatacgacatgtacgtttcgttagaaactccgacgacgaccggtcctactactacgtgtcggacgacggacggtcccgtacccgagccgtacgcgtacggtacgtacgttcggaggtacgtacggtcgggggaccggtaccgggtaaacccggttcggtacgtacgttacggtaccgtacccgtaccgtaacgtcccccg

SEQ ID NO: 355458 - DNA, 553 bp, Homo sapiens
  misc_feature: GZ8MTXP02GNMPF.44.6.A06.1.454.CMB.2.raw
  modified_base (250)..(250): a, c, t, g, unknown or other
  misc_feature (250)..(250): n is a, c, g, or t
  modified_base (263)..(263): a, c, t, g, unknown or other
  misc_feature (263)..(263): n is a, c, g, or t
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (317)..(317): a, c, t, g, unknown or other
  misc_feature (317)..(317): n is a, c, g, or t
  modified_base (335)..(335): a, c, t, g, unknown or other
  misc_feature (335)..(335): n is a, c, g, or t
  modified_base (370)..(370): a, c, t, g, unknown or other
  misc_feature (370)..(370): n is a, c, g, or t
  modified_base (394)..(394): a, c, t, g, unknown or other
  misc_feature (394)..(394): n is a, c, g, or t
  modified_base (472)..(472): a, c, t, g, unknown or other
  misc_feature (472)..(472): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccctttctgcacggcctctaggaatctacagttccactactanacatcaactggtncgcagccctggacaggctgagtgatggngatcatcctntttgctcactcactcncacgagacccgtcggganaagtatacgagttaaccgcggtaacaaagtaccanacgacacagtacctcaagtcgaanaatagtagttacgttataactacgacgacgacgccgtactactacgtgtacgacgacgacggtaccgtaccgacgccncgcgagtacgtacgtcgtacgtacgacgtcggtacgggacggacggtaacgtacgtacgtacgtacgtactacctactacg

SEQ ID NO: 355459 - DNA, 527 bp, Homo sapiens
  misc_feature: GZ8MTXP02ITCRN.44.6.A06.1.454.CMB.2.raw
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
  modified_base (374)..(374): a, c, t, g, unknown or other
  misc_feature (374)..(374): n is a, c, g, or t
  modified_base (471)..(471): a, c, t, g, unknown or other
  misc_feature (471)..(471): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggcctctggaagtactaccagttcccactacttataccatcaactggtgtgccagcccctggacaagggcttgagtgagtgggngaatcatccctnttttggcttcactcacctacgcacgacgaccgttccggggcagtaattacgattaccgnggacaagtccacagacacagtctcatgacatgagtttcttagaaactccgacacgacgccgtctactactgtgacgagcggtacctaccagctacgnacgtggactcttgagtatcgtggggcacgggaacctggtacattcgtcacctcacg

SEQ ID NO: 355460 - DNA, 587 bp, Homo sapiens
  misc_feature: GZ8MTXP02G12CC.44.6.A06.1.454.CMB.2.raw
  modified_base (311)..(311): a, c, t, g, unknown or other
  misc_feature (311)..(311): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaatactaccagttccactacttataccatcaactggtgcgccagcccctggacaaggcttgagtggatgggtgaatcatccctntttttggctcactcacctacgcacgagacctccggggcagaattacgattaccgcgaacaacgtccacagacacagtctccaatgacaatgagttcttagaaactcgacgacacgccgtactactactgtcgacgagtacggtccgtaaccccgagctcgcgaacgttcgggacgtccgtttaggacgtaacgtccggtcgggggaccgtaacgggggaaaacccccgtggggttacctaacgttttcggtacccgtaaccccgttactaacccgg

SEQ ID NO: 355461 - DNA, 531 bp, Homo sapiens
  misc_feature: GZ8MTXP02JJ1S2.44.6.A06.1.454.CMB.2.raw
  modified_base (315)..(315): a, c, t, g, unknown or other
  misc_feature (315)..(315): n is a, c, g, or t
  modified_base (379)..(379): a, c, t, g, unknown or other
  misc_feature (379)..(379): n is a, c, g, or t
  modified_base (459)..(459): a, c, t, g, unknown or other
  misc_feature (459)..(459): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccacggcccctggacaaggcttgagtggatgggtggatcatccctnttttggctcactcacctacgcacgagacctcgaggggcagtattacgatccgcgacaagtccanagacacagtctaccatgaacatgattctttagaactccgacacgcggtcgtctactactgtgacgagcgtcccgtacccngcctgcacgtggactccttgaacgtcgtcggtcggggacaacgggtaccctggtctagttccgtcgactccg

SEQ ID NO: 355462 - DNA, 577 bp, Homo sapiens
  misc_feature: GZ8MTXP02GCYD8.44.6.A06.1.454.CMB.2.raw
  modified_base (383)..(383): a, c, t, g, unknown or other
  misc_feature (383)..(383): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggcctctggaagtactaccagttccactacttataccatcaactgggtgcgccaggcccctggacaagggcttgagtggatgggtgatcatccctcttttggctcactcacctacgcacgagacccttccggggcagaattacgattaccgcggacaagtccanagacacagtcctccatgacaatgagttctttagaaactccgacgacacggtccctatacctactgtcgcgagacggtcccgtacccaggcctcgcatacgggcgtcctttaggagtacgtccgggttaggggggaccaacgggggtaaccccgtggggttcctacgtttcggtacctaccgttacgtaacccgg

SEQ ID NO: 355463 - DNA, 566 bp, Homo sapiens
  misc_feature: GZ8MTXP02G3Z98.44.6.A06.1.454.CMB.2.raw
  modified_base (272)..(272): a, c, t, g, unknown or other
  misc_feature (272)..(272): n is a, c, g, or t
  modified_base (323)..(323): a, c, t, g, unknown or other
  misc_feature (323)..(323): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccgttggtcctcggtgacccctttcctgcacggcctctggaacgtactacctagttccactacttactaccatcaacgtggtncgccacggccctggacaaggcttgagtggatgggtgaatcgtactcccttnttttggcttcactcacctacgcacgagcccgttccggggacagaattacgacttaccgcggacaacgtccacacgacacacgtctacaatcgacaatgtaagttcttagaaactccgacgacgacgtccgtactactactgtgcgacgacggtccgtacccgacgctcgcgagtacggcgtacttcggtacgacgtcgtcggggacgtacggaaccggtcgtcgtactcgtactacctactcg

SEQ ID NO: 355464 - DNA, 735 bp, Homo sapiens
  misc_feature: GZ8MTXP02JB9JC.44.6.A06.1.454.CMB.2.raw
  modified_base (324)..(324): a, c, t, g, unknown or other
  misc_feature (324)..(324): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgacccctttcctgccacggcctcgtggaagtacctaccagttcccacttacttataccatcaactgggtgccgccacggcccctggacaaggcttgagtggatgggtgaatcatcccttnttttggctcactcacctacgcacgacgtacccgttccggggacaagtaacttacgacttacccggcggaacaaacggtcccaacgacgaaccaacgtacgtccctacccaagtacgaactaaagttagttaacgttttacctttaagaaaaccgttacccggaaaccgaaccgtaacccgggtccccgttaacttaacccgttaaccgttggttacggaccggtaacgggtaacccgggttacccccgttaaacccccgaaggtccccgttaccggaccgaacggttacgggaccgttacccgttttagggaacgttaaccggttccggggtacggggggacctaaaccgggggtaaaccccgttggggttaacctaacggtttcggtaccctaacccgtacgtaacccgg

SEQ ID NO: 355465 - DNA, 593 bp, Homo sapiens
  misc_feature: GZ8MTXP02JANMJ.44.6.A06.1.454.CMB.2.raw
  modified_base (204)..(204): a, c, t, g, unknown or other
  misc_feature (204)..(204): n is a, c, g, or t
  modified_base (214)..(214): a, c, t, g, unknown or other
  misc_feature (214)..(214): n is a, c, g, or t
  modified_base (307)..(307): a, c, t, g, unknown or other
  misc_feature (307)..(307): n is a, c, g, or t
  modified_base (321)..(321): a, c, t, g, unknown or other
  misc_feature (321)..(321): n is a, c, g, or t
  modified_base (360)..(360): a, c, t, g, unknown or other
  misc_feature (360)..(360): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtnaccctttccngcacggcctctggaagtactaccagttcccacttacttataccatcaactgggtgcgccaggcccctggaccaagggcttgacgtggatgggngaatcactcccttnttttggctcactcacctacgcacgacgaccgttccgggnacgtaatacgtacgtacgtcggacacgtaccacagacacagtctcactgaacatagtagttctttagtaactacgacgacgacgccgtctactacgtcgtgtacgagacggtaccgtaccccgacgctaccgcacgttcggacgtaccgtttcggtagaacgttccggtagggggtccggaacgggtaacccgtcggttacgtacgtttcggtacctaccgttacgtaaccgg

SEQ ID NO: 355466 - DNA, 599 bp, Homo sapiens
  misc_feature: GZ8MTXP02FUVS4.44.6.A06.1.454.CMB.2.raw
  modified_base (265)..(265): a, c, t, g, unknown or other
  misc_feature (265)..(265): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccgttggtcctcggtcgtacccctttctgccaccggccttcgtggaaacgtacctaccagttcccaacttacttanacccatcaacgtgggtcgcgccacggcccctggacgaagggcttggagtggagtgggtaggaactcacttcccttcttttggctcactcacctacgcacgagacccgtccgggcaagtaacttacgacgttaccgcggtaacaacgtccacagacacatcctacatgaacatgtattacttagaactccgacgacaccggcctactactacgtgtgacgtacgacggttccccgacccgacgctcgcacgttcggacttcgttaggagtacgttcgggcgggggaccaacggggtaacccgtggtacctacgtttcgacctaccgtcgtaaccg

SEQ ID NO: 355467 - DNA, 555 bp, Homo sapiens
  misc_feature: GZ8MTXP02H1VUC.44.6.A06.1.454.CMB.2.raw
  modified_base (317)..(317): a, c, t, g, unknown or other
  misc_feature (317)..(317): n is a, c, g, or t
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgccacggcctctggaagtactaccagttccactacttatacccatcaactgggtgcgccaggcccctggacaagggcttgagtggatgggtggatcatccctnttttggctcactcacctacgcacgagacccttccggggcagaattacgattaccgcgtacaagtccanagacacagtcncatgacaatgattcttgaaatccgacgacacggcgtctactactgtagcgagacggtccccgtacccagtcctcgcaagttcggagtccctttggagtacgtcggtacgggggacacgggggtaacccgtgggtactacgttcgtcctaccgttcgacg

SEQ ID NO: 355468 - DNA, 586 bp, Homo sapiens
  misc_feature: GZ8MTXP02JKSXT.44.6.A06.1.454.CMB.2.raw
  modified_base (259)..(259): a, c, t, g, unknown or other
  misc_feature (259)..(259): n is a, c, g, or t
  modified_base (325)..(325): a, c, t, g, unknown or other
  misc_feature (325)..(325): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgacccttttcctgccacggcctcgtggaagtacctaccagttcccacttacttanaccatcaactggtgcgccacggcccctaggacaagggcttgagtggagtgggtagaatcatccctnttttggctcactcacctacgcacgacgacccgttccggggacagtaacttacgacgttaccgcggaacaacgtccacgacgacacacgtcctcatagacaatgtattcttagaactcgacgacacggcctatactagtgtagacggtagaccggtacccgtacccgagtccgacgcacgtcggacgtcctttaggacgtacgtcggtacgggggactaacggggaaccgttcggtactacgttacgtacctaccgcgtacg

SEQ ID NO: 355469 - DNA, 640 bp, Homo sapiens
  misc_feature: GZ8MTXP02FJ74L.44.6.A06.1.454.CMB.2.raw
  modified_base (316)..(316): a, c, t, g, unknown or other
  misc_feature (316)..(316): n is a, c, g, or t
  modified_base (631)..(631): a, c, t, g, unknown or other
  misc_feature (631)..(631): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcaccggcctctggaatactaccagttccactacttataccatcaactgggtgcgccaggcccctggacaaggcttgagtggagtgggtggaatcatccctnttttggctcactcacctacgcacggtacgtaccccggtcgacaagtaacgtacgtaccgttaccggaccgtaacgtaccgtaacaccgaacgtacaacgtacgttccctactacgtaacaaactagtacgttacgtttacgttaaactaaccgtaccgaaccgaacgtacccggtacctaactacctgtacggtacggacgacggtaccgttccccgaaccgtaccgtcgacgtacgtcggtacgtacgttacgtacgacgtacgttcgggggacggacggtaaccgtcggtacgttcgtacgttccgtcgtacncggtacccg

SEQ ID NO: 355470 - DNA, 626 bp, Homo sapiens
  misc_feature: GZ8MTXP02IOMXU.44.6.A06.1.454.CMB.2.raw
  modified_base (360)..(360): a, c, t, g, unknown or other
  misc_feature (360)..(360): n is a, c, g, or t
  modified_base (504)..(504): a, c, t, g, unknown or other
  misc_feature (504)..(504): n is a, c, g, or t
tcagacagtatatacacgaccggtgctcgatttagatctactgacaaccacattcctcctctaaagaagcccctgggagcacagctcatcaccatggactggacctggaggttcctcttttgtggtggcagcagcaacaggtgtccagtccctggtgcaactggtgcagtctgggactagaatgccgcaaccttggtcctcggtgaccctttcctgccacggcctcgtggaacgtactaccagttccacttacttaactaccatacaacgtgggtcgcgccgacggccccgtaggaccgaagggcttggagtggagtggggtggaatcgtactcccgttcttttcggccttacactaccncccgtaacgcgaccgtaggacccgttaccggggactacgtaacttacgtacgttaccggcggaccaaacgtccacaagacacacgtctaccatgaacagtagacgtttctttagaactcgacgacgaccggtctactcgttacncggttcgacgcgacggtaccgtacccgacgctacgcgagtacggtacgtcgttacgcgtacggtcgtcgggggacctacggggaaccctagggttactacgttcgtacctaccgtcgtaccg

SEQ ID NO: 355471 - DNA, 731 bp, Homo sapiens
  misc_feature: GZ8MTXP02JS486.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtactaccagttccactacttataccatacaacgtgggtgccgccgacggccccgtggaacgaacgggtcttgacggtggagtggggtaggtaactcgacttccccgtttcgtttttcggccttccgtacttccaaccccttaccgaccaaccggtacggtaaccccggtttacccgggggactaacgggtaaacgtttaaccggtaacgtttaccccggacggggaaccctaaacggtccccaaacgaacgaacccacgtaacgtaccctaccaattacgaaacctaatcggtaacgttttaccgttaacgaaacgttcccggaaccgaaccgtacccggtacccgtttacctaacgttaacgtggttaccggacgtaaccggtccgggtacccccgtacccaggtccctcgactaggtcggtacgtccgtttagacgtcgttcgggacggggacgaccggggtaaccgtcggtactacgttcgtacctaccgtcgtaaccg

SEQ ID NO: 355472 - DNA, 675 bp, Homo sapiens
  misc_feature: GZ8MTXP02H8T2O.44.6.A06.1.454.CMB.2.raw
  modified_base (253)..(253): a, c, t, g, unknown or other
  misc_feature (253)..(253): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtacctaccagttccacttacttanaccatcaactgggtgcgccacggcccctggacaagggcttggagtggagtgggtggaatcactccctgttttcggctccactccacctaccgcacgacgtacccgttccggggcacgaacttacgacttaccgcggaccaaacgtcccaacagacacgagtctaccatagacaatgtacgttcttagaaactccgacgacgaccggtcccgtactaccgtacttggtacggacgtaacggtaccggttccccggtaaccccgacggtccgtaccggtacgtacggttacggggtaaccgttcccgtttttacgggacggttaaacggttccgggttacggggggacccgtaaccgggggtaaacccccgttggggttacccgtacgtttaccggtacccgtaacccgttccggttaacccgg

SEQ ID NO: 355473 - DNA, 579 bp, Homo sapiens
  misc_feature: GZ8MTXP02JSJ4K.44.6.A06.1.454.CMB.2.raw
  modified_base (267)..(267): a, c, t, g, unknown or other
  misc_feature (267)..(267): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttcccactacttataccatcaactggtncgccacggcccctggacaggcttgagtggagtgggtggaatcatccctcttttggctcactcacctacgcacgagaccttccggggcagaacttacgattaccgcgacaagtccacagacacagtctacatgacaatgtagttcttagaaactccgacgacgacggccgtactactactgtcgcgaacgcggtccgtacccccgagccgtcgactacgtacgggacgtcctttaggacgtacgttcggtacgggggcctaacgggggtaacccttgggtcgtacgtttcggtacctaacccgttcgaaccgg

SEQ ID NO: 355474 - DNA, 641 bp, Homo sapiens
  misc_feature: GZ8MTXP02GST35.44.6.A06.1.454.CMB.2.raw
  modified_base (270)..(270): a, c, t, g, unknown or other
  misc_feature (270)..(270): n is a, c, g, or t
  modified_base (549)..(549): a, c, t, g, unknown or other
  misc_feature (549)..(549): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccgttggtcctcggtgacccctttcctgccacggcctctggaatacctacagttccactacttataccatcaacgtgggtnccgccacggcccctaggacaaggtcttggaggtggagtggggtgaatcgtacgttccctttgttttggctcacttcacctacgcacgtacgtacccgttccgggactaacggtaacttacgtacgttacccggccggaactaaacggtacccaacgaacgaacacgacgttcctcaatcgaaacgtatagttacgtttccttaagaaactccggaacgactaccgggtccttacgtactacgtgtacgcgaacgccggtccctacccgagccgtcgacngttcggacgttcttaggagtacgtcggggaggggacccgtaacgggggtaaccttcgggtacttacgtttccgacgtccccgttaagccccg

SEQ ID NO: 355475 - DNA, 612 bp, Homo sapiens
  misc_feature: GZ8MTXP02HG6DK.44.6.A06.1.454.CMB.2.raw
  modified_base (301)..(301): a, c, t, g, unknown or other
  misc_feature (301)..(301): n is a, c, g, or t
  modified_base (312)..(312): a, c, t, g, unknown or other
  misc_feature (312)..(312): n is a, c, g, or t
  modified_base (503)..(503): a, c, t, g, unknown or other
  misc_feature (503)..(503): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcaccggcctcgtggaagttactaccagttccactacttataccatcaactggtgcgccaggccctggacaaggctgagtgagtggngatcatccctnttttggctcactcacctacgcacgagaccccttccggggcagacttacgacttaccgcgacaacgtccacagacacagtcctaccatagacaaattgtagtttccttaagaaactcccgaacgaccgtaccgggcccgttactaccgttaactggtcggacgacggtaccggtaccccgttaacccccggngtcccgtacgacgtacgtacggtacttcgttacggacgtacggttaccgggacggggacccgtaacgggtaacccgtacgttacgttcgaccgtacctcgtaccgtccg

SEQ ID NO: 355476 - DNA, 581 bp, Homo sapiens
  misc_feature: GZ8MTXP02I1SK9.44.6.A06.1.454.CMB.2.raw
  modified_base (267)..(267): a, c, t, g, unknown or other
  misc_feature (267)..(267): n is a, c, g, or t
  modified_base (303)..(303): a, c, t, g, unknown or other
  misc_feature (303)..(303): n is a, c, g, or t
  modified_base (318)..(318): a, c, t, g, unknown or other
  misc_feature (318)..(318): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttctgcacggcctctggaagtactaccagttccacttacttataccatcaactggtncgccaggcccctggacaaggcttgagtggagtgggnggaatcactcccttnttttggctcactcacctacgcacgagacccgttccggggcacgtaattacgacgttaccgcggaacaacggtccacacgacacacgtctccgatcgaactaagtgtagtttcctttagaaacgtccgaacgacgaccggtccgttactaactacgtcgtgacgtagtacgttcccgaccccgagctacgctagtcggatccgttgacgacgtcgtacggggcgtaacgggtaaccgtcggtactacgttcgtcacgttcgacg

SEQ ID NO: 355477 - DNA, 558 bp, Homo sapiens
  misc_feature: GZ8MTXP02G5Z2Z.44.6.A06.1.454.CMB.2.raw
  modified_base (303)..(303): a, c, t, g, unknown or other
  misc_feature (303)..(303): n is a, c, g, or t
  modified_base (507)..(507): a, c, t, g, unknown or other
  misc_feature (507)..(507): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgcacggcctctggaagtactaccagttcccactacttataccatcaactggtgcgccaggcccctggacaagggcttgagtggatggnggaatcatcctcttttgctcactcacctacgcacgacgacccgttcggggcagaacttacgaacttaccgcggaaccaagtcccaacagacacacgtcctcatgacaatgtatcttagaatccgacgacgacgccgtactactactgtcgcgagacgtcctacccagcctcgctagtacggagtcctttagagtacgttccggngggggacaacgggtaacccgtggtacctagttcggtcaaccgttctaaccg

SEQ ID NO: 355478 - DNA, 846 bp, Homo sapiens
  misc_feature: GZ8MTXP02F70XK.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtcgtgggactagaatcgccgacaaccgttggtcctcggtctacccctttctgccaccggtcctcgtagggaaactacctacctacgttacccacttacttatacccatacaacgtgggtcgccgccgacggccccgtggaacgaaggtcttggagtggtagtgggtaggactcgtacttcccttcgttttcggccttacactccgacctacgccgtaacggtacgtaccccggttaccggggactaacgtaacgttacggtaaccgttacccggaccggggtaaccaacggtacccgaaccgaacggaaccaaccgtacggttaccctaaccgtaacgtaacgtaaccgtaaagtttacgggttaacgttttacccgtttaaacggtaaaacccgttacccgggtaaacccgaaccggtaaccccggggttaccccgttaacccgttaaaccgtttaccggtacgggttaacgggacccgggtaacggttaacccggggttacccccggttaacccccggtacggtacccgtcccggtaccgtaaggggttaccggtaaccggttccgttttacgggaacgggttacgttcccgggggtacgggggtaacccggtaccgggggtaaacccggttcgggttaaccgtacgtttaccggacctaacccgttcggtaaccg

SEQ ID NO: 355479 - DNA, 622 bp, Homo sapiens
  misc_feature: GZ8MTXP02INA34.44.6.A06.1.454.CMB.2.raw
  modified_base (204)..(204): a, c, t, g, unknown or other
  misc_feature (204)..(204): n is a, c, g, or t
  modified_base (273)..(273): a, c, t, g, unknown or other
  misc_feature (273)..(273): n is a, c, g, or t
  modified_base (520)..(520): a, c, t, g, unknown or other
  misc_feature (520)..(520): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtnacccctttctgccacggcctgtggaagtacctaccagttcccacttacttatacccatcaacgtgggtncgccacggcccctaggacaagggcttggagtggagtgggtaggatcgacttccccttgtttttggctctactcacctcgcacgagtaccccgttccggggcaagtaacgttacgacgttacccgacgggacaaacgtccacacgacactacgtcctcgatagactaatgtagttctttagaaactccgacgacgacgtccgtactacgttactgtcggacgacggtacggtcccgtacccgagtccncgtacagttcgggacgttacctttgggaacacggttccgggtacgggggacctaacggggtaacccgttggtaccttacgttcgtaccaccgttacgtaccg

SEQ ID NO: 355480 - DNA, 675 bp, Homo sapiens
  misc_feature: GZ8MTXP02FXBMY.44.6.A06.1.454.CMB.2.raw
  modified_base (378)..(378): a, c, t, g, unknown or other
  misc_feature (378)..(378): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagatgccgcaaccttggtcctcggtcgtacccctttcctgccaccgggtcctcgtggaacgtacctaccagttcccacttacttatacccatcaactgggtcgcgccacggcccctggacgaaggcttgaggtggagtgggtggaatcacttcccttcgttttggctcactctacctacgcacgagtacccgtccgggganagtaattacgacttaccgcggaacaacgtccaacgagaacacgtacgtcctacctatagaaactagttagtacgttactttaacgaaaccgttcccgaaccgaaccgtaccgggtaccccgttactaaccgtacgtaggttacggacggaacggtaccggtcccgtacccccgaaggtccctacggcaacgtacgggtacgtccgtttagacgtacgttccgggtacgggggtaccgaaccgggggtaacccgtggggttacctaacggtttccgtaccgtaaccgttcgtaaccgg

SEQ ID NO: 355481 - DNA, 598 bp, Homo sapiens
  misc_feature: GZ8MTXP02IBI11.44.6.A06.1.454.CMB.2.raw
  modified_base (213)..(213): a, c, t, g, unknown or other
  misc_feature (213)..(213): n is a, c, g, or t
  modified_base (236)..(236): a, c, t, g, unknown or other
  misc_feature (236)..(236): n is a, c, g, or t
  modified_base (266)..(266): a, c, t, g, unknown or other
  misc_feature (266)..(266): n is a, c, g, or t
  modified_base (319)..(319): a, c, t, g, unknown or other
  misc_feature (319)..(319): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcngcacggcctctggaatactaccngttccacttacttataccatcaactgggtncgcaggcccctggacaagggcttgagtggagtggggtgaatcaactcccgttntttttggctcactcacctacgcacgagacccgttccggggcagaacttacgattaccgcgaacaagtccacaagaccacacgtccctacatacgaacaaagtgtagtttctttagaaactcccgacgtacacccggccttacgtactactggtacgacgaggtaacggtcctacccgaggcctcgccaagttcggactccgtttacggagtactccgggtcgggggtaccgacggggaacccctggtaccgtaagtttcggcctaaccgttcgaacccg

SEQ ID NO: 355482 - DNA, 603 bp, Homo sapiens
  misc_feature: GZ8MTXP02JW4TY.44.6.A06.1.454.CMB.2.raw
  modified_base (391)..(391): a, c, t, g, unknown or other
  misc_feature (391)..(391): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactgggtgcgccaggcccctggacaagggcttgagtggagtggtggaatcatccctcttttggctctactcacctacgcacgagcccttccggggcagtaacttacgacttaccgcggtaacaacggtccanacgacacagtactcccatcgactaatgtacgttcttagaaaacgtccgacgtacgaccggtccgtactacgtaccgtagtgacgaagtacggtacccgttaccccgaggcccttcgactagtacgggtacgtcccgtttaggacgtacgttccggtacgggggaccgaaggggtaaccccctggggtaccagtttcgacctacctacgtacg

SEQ ID NO: 355483 - DNA, 625 bp, Homo sapiens
  misc_feature: GZ8MTXP02IKU5N.44.6.A06.1.454.CMB.2.raw
  modified_base (378)..(378): a, c, t, g, unknown or other
  misc_feature (378)..(378): n is a, c, g, or t
  modified_base (518)..(518): a, c, t, g, unknown or other
  misc_feature (518)..(518): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgacccctttcctgccacggcctcgtaggaacgtactaccgtacgttccacttacttactacctatcaacgtgggtgccgccgacggcccctggacgaaggcttggagtggagtgggtaggaatctactcccttgttttggctcactcacctacgctacgagtacccgtccggganagtaattacgacttaccgcgaacaacgtccacagacacagtcctaccatagaactaaagtgttagttacttacgaaactcccgacgaccacggtcccttacacgttactgtcggacgaacggacgtaccccgtaacccgngccctacggccagttacggggcttccgtttaggacgtacggttcgggacgggggtaccgaacggggtaacccgtgggtaccagttcgtacccgtacctctaacccgg

SEQ ID NO: 355484 - DNA, 668 bp, Homo sapiens
  misc_feature: GZ8MTXP02GDFAV.44.6.A06.1.454.CMB.2.raw
  modified_base (271)..(271): a, c, t, g, unknown or other
  misc_feature (271)..(271): n is a, c, g, or t
  modified_base (282)..(282): a, c, t, g, unknown or other
  misc_feature (282)..(282): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtcgtgggactagaatgccgcaaccttggtcctcggtcgtaccctttcctgcacggcctcgtggaagtactaccagttccactacttataccatcaactgggtncgccacgcccnggacgaggtctgagtggagtgggtagatcacttcccctttgtttcgtctacctcctactaccgacgacgaacgtacgtaccccgggtcgacgtaagtaacgttacgtaacccgttaccgggaccgaaaccgtaacgtaccgaacgaacgaaccacgtaacttccctaacgtacgtaacgaaacttagtaacggtttactttacggtaaacgttacccgaccgaaaccgtacggtacccggttacttaacgtaccgtgtacgcggtaacggacgtcccgtacccgaacgcgtccggacacgtacgcgttcccgttagtcgaaggttccgtgggggtacggaccgtaaaccggtaaccgtgtacgttagtccgacctacgactacccg

SEQ ID NO: 355485 - DNA, 656 bp, Homo sapiens
  misc_feature: GZ8MTXP02GBV42.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtcgtgggactagaatgccgcaaccttggtcctcggtcgacccctttcctgccacggcctcgtggaagtactaccagttccactacttataccatcacgtggtcgcgccacgcccgtggacgaggtctggagtggagtgggtagactctacttcctttgtttgctcactccacctacgcacgacgtacccgtccgggatagtaacttacgacgttaccggcgaacaacgtccaacgacacacgacgttccactaagtacgaactaagttgttacgtttacgtttacgaaacgtccgaacgaccggtaccggttcccttaccttaccgttagtcgtacgggaacgacggtacccggttacccccgtacccgaacgtcgtaccgacgtacggtcggtaccgttccggtttaggaacgtcggttccgggtacgggggaccgtaaaccgggtaaccgttcggtaccgtacgtttccgcctaccgtcgtacccg

SEQ ID NO: 355486 - DNA, 570 bp, Homo sapiens
  misc_feature: GZ8MTXP02G7FJF.44.6.A06.1.454.CMB.2.raw
  modified_base (265)..(265): a, c, t, g, unknown or other
  misc_feature (265)..(265): n is a, c, g, or t
  modified_base (355)..(355): a, c, t, g, unknown or other
  misc_feature (355)..(355): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaagtctaccagttccactacttataccatcaactgggtncgccaggcccctggacaggcttgagtggagtgggtgaatcattcccttgttttgctcactcacctacgcacgtagacccgttccgggganagaattacgacttaccgcggacaagtccacacgacacacgtctaccatgaacaatgtagtttccttagaaactccgaacgacaccggtccgtactactactgtgacgagacggtcccgaccagcctacgcagtcggactctttgacgtacgtcgggtacggggacgtacggggaacccgtggtacgtacgttcggtacctcccgtacgtaaccgg

SEQ ID NO: 355487 - DNA, 667 bp, Homo sapiens
  misc_feature: GZ8MTXP02J1HPG.44.6.A06.1.454.CMB.2.raw
  modified_base (438)..(438): a, c, t, g, unknown or other
  misc_feature (438)..(438): n is a, c, g, or t
  modified_base (547)..(547): a, c, t, g, unknown or other
  misc_feature (547)..(547): n is a, c, g, or t
tcagacagtatatacacgaccggtgctcgatttagatctactgacgaaccacattcctcctctaaagaagcccctgggagcacagctcatcaccatggactggacctggaggttcctctttgtggtggcagcagcaacaggttgtccagtccctggtagcaactggtgcagtctgggactagaatgccgcaaccgttggtcctcggtcgtaccctttcctgccacgggtcctgtggaacgtacctaccacgttccacttacttactacctatcacgtggtgcgccacggcccctggacgaggcttgaggtggagtcgggtagaatcgtactccgtttgttttcggctcctactccgacctaccgacacggtacgtaccccggttaccgggactaacgtaacttaccggtacgttaccggcggaacgaaaccgtccaanaacgtaccaacgtacgtaccctaccaattcgaaaccgtaagtgtacgtttactttaacgaaaactcccgaaacgtacgacccggtaccgtactactacgtggtcgacgngacccggttacccgacccgtagcctagcgtagtcgggactcttacgggacgtacgttcgggacgggggtccaacgggggtaacctacggtcgtacgtttcgaccgaaccgttcgaacccg

SEQ ID NO: 355488 - DNA, 563 bp, Homo sapiens
  misc_feature: GZ8MTXP02HRSWS.44.6.A06.1.454.CMB.2.raw
  modified_base (214)..(214): a, c, t, g, unknown or other
  misc_feature (214)..(214): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggcctcggtcgaccctttccngcacggcctctggaagtactaccagttccactacttataccatcaactgggtgcgccaggcccctggacaagggcttgagtggagtgggtggatcatccctcttttggctcactcacctacgccacgagtaccccgttccggggacagaattacgacttaccgcggacaagtccacgagacacacgtctcatgaacatgtagttctttagaaatccggactacgacggtccgttctacttactggtcgcgaggacggtcccgaccccgagcctcgcgatgggacgtcctttgagtactcggtggggaccgacgggaacccgtgggtactgtacgtccaccgtcgtaccg

SEQ ID NO: 355489 - DNA, 548 bp, Homo sapiens
  misc_feature: GZ8MTXP02GM442.44.6.A06.1.454.CMB.2.raw
  modified_base (266)..(266): a, c, t, g, unknown or other
  misc_feature (266)..(266): n is a, c, g, or t
  modified_base (315)..(315): a, c, t, g, unknown or other
  misc_feature (315)..(315): n is a, c, g, or t
  modified_base (395)..(395): a, c, t, g, unknown or other
  misc_feature (395)..(395): n is a, c, g, or t
  modified_base (498)..(498): a, c, t, g, unknown or other
  misc_feature (498)..(498): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttataccatcaactggtncgccaggcccctggacaagggcttgagtggatgggtggaatcatccctnttttggctcactcacctacgcacgagacccgttccggggcagaacttacgattaccgcgacaagtccacagacacagtcnccatgaacaatgagttctttagaaactccgacgacaccggtccgtactactactgtcgcgagacggtccgtaccccagctcgcagtcggagtcctttgacgtntcggtcgggggctacgggaacccgttggtctacgttcgactacctcgacg

SEQ ID NO: 355490 - DNA, 613 bp, Homo sapiens
  misc_feature: GZ8MTXP02G7GZS.44.6.A06.1.454.CMB.2.raw
  modified_base (274)..(274): a, c, t, g, unknown or other
  misc_feature (274)..(274): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgacccctttcctgccacggcctcgtaggaagtacctaccagttccacttacttataccatcaacgtggtncgccacgcccctggacaaggcttgagtggagtgggtaggaactcacgttcccttgttttaggctcactcacctacgcacgagtacccgttccggggactagaattacgattacccgcgggaactaagtacccaacagaacacacgtcctaccaatcgaacaatcgtaaagtttcttagaaactccgaacacgacggtcctactaactctagtcgacgagtacggtacccacccgagcctacgacgtaagtcggcttacctttacggatacggtcgtacgggggacaacggggtaacccttggggtactacggttacgtaccgacccttacgtaacccgg

SEQ ID NO: 355491 - DNA, 600 bp, Homo sapiens
  misc_feature: GZ8MTXP02GYPYH.44.6.A06.1.454.CMB.2.raw
  modified_base (514)..(514): a, c, t, g, unknown or other
  misc_feature (514)..(514): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttcctgccacggcctctaggaagtacctacctagttcccacttacttactaccatcaactgggtgcgccacggcccctggacgaaggcttggagtggagtgggtagatcacttcccgttgtttttcggctcctactcaccctacgcacgacgtaccccgttccggggacagtaacttacgacgttaccgcggacaacgtccacgagacacagtcctcaatcgaactagtgtagtttacttagaaactccgacgacgacggtctcgtactacgtactgtacgacgagtaccgtcccgtacccngcctcgactacgtcggacgtccgttagacgtacgtccggtggggaccgtaacgggtacccgtggtactacgttcgacctaccgtcg

SEQ ID NO: 355492 - DNA, 581 bp, Homo sapiens
  misc_feature: GZ8MTXP02IFHYO.44.6.A06.1.454.CMB.2.raw
  modified_base (266)..(266): a, c, t, g, unknown or other
  misc_feature (266)..(266): n is a, c, g, or t
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
  modified_base (404)..(404): a, c, t, g, unknown or other
  misc_feature (404)..(404): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactacagttccactacttataccatcaactgggtncgcaggcccctggacaaggcttgagtggagnggtggaatcatcctnttttgctcatcacctacgcacgagtacccgttccggggcagaacttacgacgttaccgcggaacacgtccacagacacagtcctccatcganaatgtacgttctttagaaacttccgacgaccgacggtcccgtactactactgtgcgacgtacggtccctacccagcctacgcacgtcggacgttcctttaggacgtacggttcggtacgggggccaaacgggggtaacccgttcggacgttcgttacgtcccgtaaccgtcgtaccg

SEQ ID NO: 355493 - DNA, 589 bp, Homo sapiens
  misc_feature: GZ8MTXP02F4B6Y.44.6.A06.1.454.CMB.2.raw
  modified_base (268)..(268): a, c, t, g, unknown or other
  misc_feature (268)..(268): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcaccggcctctggaagtactaccagttccactacttataccatcaacgtggtncgccaggcccctggacaaggcttgagtggagtgggtggaatcactcccttgttttcggctcactcacctacgcacgacgtacccgttccggggtataacgtacgtactaccgacggacgacgtaccacacgacacagtctccatcgacaatgtagttacttagtaaactacgtacgacgtacgtccgtactactactgtcgacgacgaccggtcccgtacccgacgactcgcgagtacggtacgtccgtttagacgtacgtccggtacggggacgaccgggaaccgtcggtactacgttcgtactaccgtcgacgtacccg

SEQ ID NO: 355494 - DNA, 585 bp, Homo sapiens
  misc_feature: GZ8MTXP02JPCVG.44.6.A06.1.454.CMB.2.raw
  modified_base (324)..(324): a, c, t, g, unknown or other
  misc_feature (324)..(324): n is a, c, g, or t
  modified_base (344)..(344): a, c, t, g, unknown or other
  misc_feature (344)..(344): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtcgtgggactagaatgcccgcaaccttggtcctcggtgacccctttctgcacggcctcgtaggaacgtactaccagttacccactacttataccatcaacgtggtgccgccacggccctggacgagggcttggagtggagtgggtgaatcatcctnttttggctcactcacctacncacgagacccgtccgggactagacttacgattaccgcggaacaacgtccacagacacacgtctaccaatcgaactaatgtaacgtttcttaagaaacgttccgacgacgaccggccgtactactacgtgtgacgaggtaccgtacccgaccctagccttcgacagtcggatccgtttaggagtacgtcgggtaggggaccgacgggtaacccgtgacttagtccgtaactccgtacgaccg

SEQ ID NO: 355495 - DNA, 636 bp, Homo sapiens
  misc_feature: GZ8MTXP02G8KK6.44.6.A06.1.454.CMB.2.raw
  modified_base (252)..(252): a, c, t, g, unknown or other
  misc_feature (252)..(252): n is a, c, g, or t
  modified_base (313)..(313): a, c, t, g, unknown or other
  misc_feature (313)..(313): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttcctgcacggcctctggaagtactaccagttccactacttanaccatcaactggtgcgccaggcccctggacaaggcttgagtggatgggtgaatcatccctnttttggctcactcacctacgcacgacgacccgttccggggctaagaattacgacttaccgcggactaacggtccaacgacgtaacacacgtcctacgaacttgaaacctaatgtaacgtttcctttagaaaacgttcccgaaacgtaacgaccggtcccgtacgttaacctacgtacgttacggacgaacggtaccggtacccccgtaaccccgacgtccgtacgcaacgttcggacgttcgtttacggagtaaccgttcgggtacgggggactaacggggaaccccgtgggtaccgtacgtttcgactaacccgtcgaaccg

SEQ ID NO: 355496 - DNA, 585 bp, Homo sapiens
  misc_feature: GZ8MTXP02I4ES4.44.6.A06.1.454.CMB.2.raw
  modified_base (204)..(204): a, c, t, g, unknown or other
  misc_feature (204)..(204): n is a, c, g, or t
  modified_base (270)..(270): a, c, t, g, unknown or other
  misc_feature (270)..(270): n is a, c, g, or t
  modified_base (313)..(313): a, c, t, g, unknown or other
  misc_feature (313)..(313): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtnacccctttcctgcacggccctctggaatactaccagttcccactacttatacccatcaactgggtncgcacggccctggacaggctgagtggatggtgatcatcccttnttttggctcactcacctacgcacgacgccgttccggggcagtaacttacgacttaccgcgaacaacgtccacacgacacacgtccacatgaacagtgtagttcttaagaaactccgacgacgaccggccgttactaccgttactgttcggacgagtacggtacccgtacccgagcctcgacacgtcggactccgtttagacgtacgttcggtacgggggccgtaacggggtaacccgtggttaccgtacgttcgtaccctaccgtcgtaccg

SEQ ID NO: 355497 - DNA, 828 bp, Homo sapiens
  misc_feature: GZ8MTXP02F7FHS.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtcgtgggactagaatcgccgactaaccgttggtccttcggtcgtacccctttcctgccgaccggcctacgtaggaacgttacctacctacgttccctaacttacttaactaccatactaacgtgggtcgccgaccgaacggccccgtaggaaccggaagggtccgttggacggtgggtaagttgggggtacggtaaatccgttaacctttccccgtttacggttttttacgggcccttacccgtaccttcccctaaaccccgttaccgaccgtaaccggaaccggtacccccgggttacccggggactaaacgtaacgttaaccgtaacgttacccggcgggtaaacaaaccggttacccaacgtaacgtaaccacgactaccgtacaacgttacgaaactaagttcgttaacgttacgttttaaacgaaaccgttaccggaccggaaccgtaccccgggttaccgttacgttaaaccgttacgttacggtacgggtaaccggtaaccggtaccgggttacccccgtaccccgaacgccttacggggactacggttaccgggtacgttacccggttaggaacggtacgtttcgggggaacgggggtaccgtaacgggggtaacccttgggtacttacggtccaccgtacctacgtacccg

SEQ ID NO: 355498 - DNA, 553 bp, Homo sapiens
  misc_feature: GZ8MTXP02JWGMU.44.6.A06.1.454.CMB.2.raw
  modified_base (204)..(204): a, c, t, g, unknown or other
  misc_feature (204)..(204): n is a, c, g, or t
  modified_base (318)..(318): a, c, t, g, unknown or other
  misc_feature (318)..(318): n is a, c, g, or t
  modified_base (358)..(358): a, c, t, g, unknown or other
  misc_feature (358)..(358): n is a, c, g, or t
  modified_base (386)..(386): a, c, t, g, unknown or other
  misc_feature (386)..(386): n is a, c, g, or t
  modified_base (451)..(451): a, c, t, g, unknown or other
  misc_feature (451)..(451): n is a, c, g, or t
  modified_base (471)..(471): a, c, t, g, unknown or other
  misc_feature (471)..(471): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtnacccctttcctgcacggcctctggaagtactaccagttccacttacttataccatcaactgggtgcgccaggcccctggacaagggcttgagtggatgggtgaatcatcccttnttttggctcactcacctacgcacgagacccgtccgggganagaacttacgattaccgcgacagtccanagacacagtcctccatcgacatgtatttcttagaaactccgacgacacggtccgtactacactgngcgagcggtcccgtacccgngcctcgcagtcggacgtccttgagtacgtccggacgggggccacggggtaacctggtactacgttcgtaccaccgttcaccg

SEQ ID NO: 355499 - DNA, 622 bp, Homo sapiens
  misc_feature: GZ8MTXP02INNPW.44.6.A06.1.454.CMB.2.raw
  modified_base (541)..(541): a, c, t, g, unknown or other
  misc_feature (541)..(541): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgtacccctttctgcacggcctcgtggaagtactaccagttccactacttataccatcaactggtgcgccacggcccctggacaagggcttggagtggagtgggtggaactcgtacttcccttgttttggcctcactccacctacgctaacgacgtaccccgttccggggactaagtaacgttacgacgtttaacccggcgggaaaccaaacgtacccaacgaacgacacgaacgtcctaccatagaactaagtgtacgttctttagaaactccgacgacaccgtaccgtactaactacgtgtacggcgacgtacggtacccgtacccagtcctacganacggtcggactcctttaggactacgtcggtacggggtcgaaccgggtaaccgtggtactacgttcgacctaccgactaccg

SEQ ID NO: 355500 - DNA, 649 bp, Homo sapiens
  misc_feature: GZ8MTXP02I04K6.44.6.A06.1.454.CMB.2.raw
  modified_base (280)..(280): a, c, t, g, unknown or other
  misc_feature (280)..(280): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgctaaccttggtcctcggtcgtacccctttcctgccacggtcctcgtggaacgtactacctacgttcccacttacttactaccatcaactgggtncgccgacggcccctggacaaggcttggagtggagtgggtggaatcactcccttgttttcggctcactcacctacgtcacgacgtacccgtccggggacaagtaaacttacgacttaccgcggacaaacgtccaacacgaacacacgtacctaccagtacgaacaattgtacgtttcttaagaaacgttcccgaaacgacgaccgggtaccttacctaacgttactcggtacgacggacgtaccgggtaccccgtaaccccgagtccgtacgactaggtacgggacttaccgtttaggaaagtcgtcgggtacgggggacctaaccgggggtaaccgtcggtacttacgttcgacctaccgtacgtaccg

SEQ ID NO: 355501 - DNA, 654 bp, Homo sapiens
  misc_feature: GZ8MTXP02JZ1XA.44.6.A06.1.454.CMB.2.raw
  modified_base (300)..(300): a, c, t, g, unknown or other
  misc_feature (300)..(300): n is a, c, g, or t
  modified_base (305)..(305): a, c, t, g, unknown or other
  misc_feature (305)..(305): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccgttggtcctcggtcgacccctttcctgccacggcctcgtggaagtacctaccagttccactacttataccatcaacgtggtgcgccacggccctggacaggctgagtgngtggngatcatcccttnttttggctcnctccacctacgcacgacgtcccgtccggggacagtaacttacgacttaaccggcgggaacctaacgtccacgacgacactacgtacctacctagtacgaactacgttagtacgtttctttaacggaaactcccggtaaacgaccgtaccgggtaccccgtttctaaccttacgtcggtacggtaccggtaacgtacccggttaccccgtaccccgcggtccgtcgactagtcgggacttcccggtttaggacgtacgtccgggcgggggtaccgaaccggggtaaccgttcgggtacctacgttcgtacccgtaccgttcgaaccgg

SEQ ID NO: 355502 - DNA, 608 bp, Homo sapiens
  misc_feature: GZ8MTXP02H7YJ1.44.6.A06.1.454.CMB.2.raw
  modified_base (394)..(394): a, c, t, g, unknown or other
  misc_feature (394)..(394): n is a, c, g, or t
  modified_base (422)..(422): a, c, t, g, unknown or other
  misc_feature (422)..(422): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcggtctgggactagaatgccgcaaccttggtcctcggtcgtaccctttcctgcacggcctcgtaggaatactacctagttccactacttactaccatacaacgtgggtcgcgccacggcccctggacgaaggctgaggtggagtgggtagatcactcccttgttttggctcactcacctacgcacgacgacgtcccgggacagaatacgactaccgcgacaacgtccanagacacactcacatgacaatgtagtttntaagaaactccgaacgtaccgacggtcctactaactctggcgacgaggtaccgtcccgtaacccngtccncgcgtaggtcggtacgttccgtttaggacgttacgtcggggtacgggggaccgtaaccggggtaaccccgttggtacctacggtttaccgaccgtacccgtacgtacgtacccccg

SEQ ID NO: 355503 - DNA, 665 bp, Homo sapiens
  misc_feature: GZ8MTXP02HOMHT.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccgtttggtcctcggtcgtacccctttccgtgccgaccggtccttcgtagggaaacgttacctacccgtagttcccaacttacttataccatacaacgtgggtgccgccgacggccccgtggacgaaggcttggagtggagtgggtagatcacttcccttgttttggctctacgtcacctacgcacggacgtacccgtccggggacagtaacttacgacgttaccgcggtaacaacgtccacgagacactacgtacctcatacgaactagttcgtatttactttacgaaacgtccgaacgtaccgtaccggtcccgttactaaccttagtggtcggacgtacggtaccggtaccccgtacccgacgtacctcggactacgtacggacgttccgtttaggacgttacggtccgggtgggggacctaacggggtaacccgttggtaccgttagttccggtacctaaccgttcgaaccg

SEQ ID NO: 355504 - DNA, 681 bp, Homo sapiens
  misc_feature: GZ8MTXP02ITY7W.44.6.A06.1.454.CMB.2.raw
  modified_base (324)..(324): a, c, t, g, unknown or other
  misc_feature (324)..(324): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgcccgcaaccttggtcctcggtgacccctttcctgcacggcctcgtaggaagtcctaccagttcccacttacttataccatcaactgggtgcgccaggcccctggacaaggccttgagtggagtgggtgaatcatccccttnttttggctcactcacctacgcacgagtacccgtccggggcagtaaacttacggaacttacccggcgggaaccaacggtcccaacgacgaacaacgagtcctaccatacgaacaaattgtaagtttccgttttagaaaaccgttcccgaaaccgaccgaaccgggtccccgttactaaccgttaccgtggttcggaccgtacggtaaccggttccccgtaacccccgtagccgttaccgcgtaacgtcgggtacgttcccgtttaggacggttacgttaccggttcggggggaacccacgggggtaaacccccgttggggtaccttacggtttcgtaccgtacccgttactaccccgg

SEQ ID NO: 355505 - DNA, 626 bp, Homo sapiens
  misc_feature: GZ8MTXP02JECAR.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctctggaatctaccagttcccactacttataccatcaactgggtgcgccaggcccctggacgaagggcttggagtggagtgggtggaatcatcccttcttttggctcactcaccctacgcacgagacccgttccggggacagtaattacggaactttacccggcgggaacaacgtcccacgaacgacacacgtctccatcgaacaatgtagtttccttagaaactaccgacgaacgaccggtccttacgtaccttacgtcggtcgaccgaacggtacggtacccgtaccccgacgtccgtacgcagtaccgggtgtacccgtttaggacgtacggtccggacggggggcctaacgggggtaacccgttgggtaaccgtacgttccggtcctaaccggtctaaccgg

SEQ ID NO: 355506 - DNA, 674 bp, Homo sapiens
  misc_feature: GZ8MTXP02JTZYQ.44.6.A06.1.454.CMB.2.raw
  modified_base (353)..(353): a, c, t, g, unknown or other
  misc_feature (353)..(353): n is a, c, g, or t
  modified_base (557)..(557): a, c, t, g, unknown or other
  misc_feature (557)..(557): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtaccccttttcctgccacggcctcgtggaacgtactaccagttcccacttacttactaccatacaacgtgggtgcgccgacggccctggacgaaggtcttgaggtggagtgggtgaatcacttccttgttttcgctcactcacctacncacgagtacccgtccgggactagaacttacgacgttaccgcggaacaacgtaccacacgacactacgtcctaccatacgacgaattcgtaacgtttctttaacgaaaacgtccggaaaccgaaccgacccggtcctaacttacccttaacgttaccgtaggtacgaccggtaacggtacccgggttacccccgttaaccccggngtacccgtacggaccgtaagggttcggaaaccgttccgtttaggaaacggtcgttacgggggtcgggggacctaaccggggtacccgttaggtcgtaacgttcgtaccctactaccg

SEQ ID NO: 355507 - DNA, 663 bp, Homo sapiens
  misc_feature: GZ8MTXP02IXJHF.44.6.A06.1.454.CMB.2.raw
  modified_base (223)..(223): a, c, t, g, unknown or other
  misc_feature (223)..(223): n is a, c, g, or t
  modified_base (268)..(268): a, c, t, g, unknown or other
  misc_feature (268)..(268): n is a, c, g, or t
  modified_base (359)..(359): a, c, t, g, unknown or other
  misc_feature (359)..(359): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccctttctgcacggcctntggaagtactaccagttcccacttacttataccatcaacgtggtncgccagccctggacaagggcttgagtggagtggtagatcactccccttgttttcggctcctactccacctacgcacgagtccgttccgggnagaatacgacttaccgcggacaacgtccacagacaacgacgtcctacccaagtacgaactaaatgtaacgtttacgtttaacggaaacttcccggaacgaccgtacccgggacccgttaccctaaccgttaccgtggttaccggacgggtaacggtacccgggtaccccgttaacccccgaggtcccgtaccgcgtaacggttcgggtaccgttccgtttacgacggttacggtccgggttcgggggaccgtaacgggggtaaacccttcgggtacttacgtacgttcccaaccgtttccaccg

SEQ ID NO: 355508 - DNA, 631 bp, Homo sapiens
  misc_feature: GZ8MTXP02H9XUS.44.6.A06.1.454.CMB.2.raw
  modified_base (225)..(225): a, c, t, g, unknown or other
  misc_feature (225)..(225): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactaggaatgccgcaaccttggtcctcggtgaccctttcctgcacggcctntggaagtactaccagttccactacttataccatcaactgggtgcgccacggcccctggacaagggcttgagtggatgggtggatcatccctcttttggctcactcacctacgcacgagacccgtccggggactagtaacttacgacttaaccggcggaacaaacgtcccgaacaacgacacaacgtcctaccagtagaactaaagtcgtaaagtttctttaagaaaacgtcccgaacgtaaccacgggtcccttaacgtacttaacgtacgtacggtacgacggacggtacccggtaccccgaacgaccgtcgtaccgctaggacggtacttccggttaggagtacgtaccggggtacgggacgtaacccgggacggttcgtacgtagttccgtactaccgtaccg

SEQ ID NO: 355509 - DNA, 623 bp, Homo sapiens
  misc_feature: GZ8MTXP02JUWGI.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttcctgccacggcctctggaacgtactacctagttccacttacttataccatcaacgtggtgcgccacggcccctggacgaaggcttggagtggagtgggtaggaatcacttccccgtttgttttcggcctctactccaccgtacgcaacggacgtacccgttccggggactagaacttacgacttaccgcggaaccaacgtcccaacgacgacactacgtcctaccaatacgaactaatgtaacgtttctttaagaaactccggaaacacgaccgggtcctactactacgtgtcgacgacgtaccggtaccctacccgagcctacgacgagttacgggacttccgttagacgtacgtcgggtacggggccaacggggtaaccctggtactacgttacgccacgtctaccg

SEQ ID NO: 355510 - DNA, 600 bp, Homo sapiens
  misc_feature: GZ8MTXP02GCGNK.44.6.A06.1.454.CMB.2.raw
  modified_base (298)..(298): a, c, t, g, unknown or other
  misc_feature (298)..(298): n is a, c, g, or t
  modified_base (320)..(320): a, c, t, g, unknown or other
  misc_feature (320)..(320): n is a, c, g, or t
  modified_base (335)..(335): a, c, t, g, unknown or other
  misc_feature (335)..(335): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgaccctttcctgcacggcctctggaagtactaccagttccactacttataccatcaactggtgcgcaggccctggacagggctgagtggatggnggatcatccctcttttggctcnctcacctacgcacgngacccttccggggcagacttacgattacgcgacagtccacacgacacagtcctcaatgaacatagtagttacttagaaagtccgaacgacgaccggtaccgtcttaacctacgtcgtacgcgaacggacggtccccgtacccgaagtcccgttacgccgtagttacgggaacgttccgtttaagcgtaacggtcgttacgggggacgtaacgggggtaacccgttacggtaccgtaagtttccgttccggaaccctacgtaccgg

SEQ ID NO: 355511 - DNA, 623 bp, Homo sapiens
  misc_feature: GZ8MTXP02IIIWL.44.6.A06.1.454.CMB.2.raw
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (366)..(366): a, c, t, g, unknown or other
  misc_feature (366)..(366): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
tcagacagtatatacacgaccggtgctcgatttagatctactgacaaccacattcctcctctaaaagaagcccctgggagcacagctcatcaccatggactggacctggaggttcctctttgtggtggcagcagcaacaggtgtccagtccctggtgcaactggtgcagtctgggactagaatgccgcaaccgttggtcctcggtcgtaccctttcctgcaccggcctcgtaggaacgtactacctagttccaacttacttactaccatcaactgggtncgcagcccnggacaaggctgagtggagtgggtgaatcactccttcgttttggctcactcacctacgcacgagtaccgtaccgggtanattacgattaccgcgacgaagtacacanaacnactcctacangaacatagtagtttactttagtaaactaccgaccgaacgaccggaccgttaccttactacgtagtcgacggacgtacgggtaccccgtacccgaggtccgacgtaccgagtacggacggtcccgtttagacgtacgttcggttcgggggaaccgtaacgggtaacccggtaaggttacgtacgttacgtaccgtaccctacgtaacttaccccgg

SEQ ID NO: 355512 - DNA, 770 bp, Homo sapiens
  misc_feature: GZ8MTXP02I7DBJ.44.6.A06.1.454.CMB.2.raw
  modified_base (222)..(222): a, c, t, g, unknown or other
  misc_feature (222)..(222): n is a, c, g, or t
  modified_base (542)..(542): a, c, t, g, unknown or other
  misc_feature (542)..(542): n is a, c, g, or t
  modified_base (649)..(649): a, c, t, g, unknown or other
  misc_feature (649)..(649): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtcgtgggactagaatcgccgacaaccgttggtcctacggtcgtacccctttccngaccaccggcctcgtaggaacgtacctacctagttcccaactacttactacctatcaacgttggggcgtaccgccgacggcccccgtaggaacgaagggtcttcggaggtggaggtttggggtaggtaactacaccgtttcccccgtttgtttttacgggcctttccctacccttacctaaaccccgttacgaccgaaccggtacggtacccccggttacccggggactaaaggtaaccgtttaccgaaccggttacccgaccggggtaaacctaacggtacccaaccgtaacggacctacgtacgtccctacgagttanaactagttcgtaagtttcttaagaaaccttcggaccgtacgaccgggtcccttacgtacgttacgtcggtacgggaccgcggtaacccggttccccgtaacccccgngaccgtcgaacgtcgtacggtccgttaccgtttggaaacgcggttacgggtaccggggaccgtaaacggggtaaccccgttggtaaccgtcgttccgttaaccccgcgtaaccggttcccg

SEQ ID NO: 355513 - DNA, 603 bp, Homo sapiens
  misc_feature: GZ8MTXP02JOS7Z.44.6.A06.1.454.CMB.2.raw
  modified_base (204)..(204): a, c, t, g, unknown or other
  misc_feature (204)..(204): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtnacccctttctgcacggcctcgtggaagtactaccagttccacttacttataccatcaactgggtagcgccaggccccaggaccaaggcttagagtggagtgggaggaatcatcccttcttttgctcactcacctacgcacgacgaccgttccggggcagtaaattacgacttaaccgcggaacaaacgtaccaacagtaaccaacagtacctaccagtacgaactaaatgacgtttactttagaaaacttccgaacgaacaaccgggcctaacttacctaacgtgtacggcgaagaacggtacccgtaacccagtccgacgcaatagggatccttaggaactagtcggtcgggggacaacgggggtaaccctgggtataacgttgtaccaccttcaaac

SEQ ID NO: 355514 - DNA, 705 bp, Homo sapiens
  misc_feature: GZ8MTXP02JXDYG.44.6.A06.1.454.CMB.2.raw
  modified_base (142)..(142): a, c, t, g, unknown or other
  misc_feature (142)..(142): n is a, c, g, or t
  modified_base (223)..(223): a, c, t, g, unknown or other
  misc_feature (223)..(223): n is a, c, g, or t
  modified_base (600)..(600): a, c, t, g, unknown or other
  misc_feature (600)..(600): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtntccagtccctggtgcaactggtgcagtctgggactagaatcgccgacaaccgttcggtcctcgggttctaccccttttccnggccacggcctagtaggaacgttacctacctagttcccaacttacttaactacatcaacgtgggtagccgccgacggtcccctagggacgaagggtccttaggagtcggagtggtaggaactcaccgttccttgttttcggctcacctacaccgtacgacgaccgtagtaccccgttcggggacacggttaacgtaccgtacgttacccgggacggggtaacctaacggttcccaaacgacgtacacctaacgtccctacttaacgcgtaaccgaagttcgttacgtttacgtttaacgaaaccttaccgggaccgtaaaccgaccggtccttactacccgtagttgtaccggacgacgtaccggtccctaacccgngaccgtcgacgtacgtacggtacctcgttacggtacggtacggttcgggacgggtaaccggtacggtccgtacggtagtcgttaccgtaccgtacgtacgtaccg

SEQ ID NO: 355515 - DNA, 760 bp, Homo sapiens
  misc_feature: GZ8MTXP02FM72Y.44.6.A06.1.454.CMB.2.raw
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtcgtgggactagaatgccgcaaccgttggtcctcggtcgtaccctttcctgccgacggccttcgtaggaaagtacctaacctagttcccaactacttactaccatacaacgtgggtcgccgcccgacggccccctagggaaccgaagggtccttaggaggtggagtggggtagaactcgtacttcccgtttcgttttcggccttccgaaccttccacccgtaccgcctaacggtacggtaccccgtttaccggggacaaggtaacgttacgtacgttaacccgggcggaacctaaacgtccaaacgacgtaacacgacgtaccctctaagtacgaaactaagttgtaacgtttctttaagaaaccgttacccgaaacgcccgtaaaccgggtccctaaccttaccgtagtcggtacggaaccgtacgtaaccgggttcccccgaaccccgacgtcccgtaccggtacgtaacgtcgggtaccgttcccgtttaagggaaacgggttcgtaccgggggtagggggtacccgaaacccggggttaaacccgtggtttactaacggttttcccgaaccttacccgtcggtccccg

SEQ ID NO: 355516 - DNA, 837 bp, Homo sapiens
  misc_feature: GZ8MTXP02IA3U5.44.6.A06.1.454.CMB.2.raw
  modified_base (217)..(217): a, c, t, g, unknown or other
  misc_feature (217)..(217): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtcgtgggactagaatgccgcaaccgttggtcctcggtctaccctttccngccacggcctcgtaggaacttactacctagttaccacttacttataccatcaacgtgggtcgcgtccgacggccccgtggaaccgaagggtcttaggaggtggagtgggtaggtaactcgtacttccccgtttcgtttttacggcccttacgtaacccttccgtaacccgtaccggcctaaccggtaaccggtaccccggtttcccccgggggactaaacgggtaaacgtttaaccggtaaccgtttaaccccgggaccggggtaaacctaaaaccggttaccccgaaaccgtaacgggaaccaaaccgtaccggttacccttaccgaacgttaacggaaaccttaaagttcggttaaacgttttaccgtttaaacggaaaaccttacccggaaacgtaacccgaacccgggtcccgtttaccgtaaaccgttacgttacgggttacggaccggtaaccgggtacggttacccccgtacccgtaacgcccgttaccgaccgtaaggttcgggtacgttacccggtttagaaacgtacgtttccggggtacgggggccgtaaaacccgggggtaacccgttggaccgttaacgtttcggacccgttacctaccggtaaccg

SEQ ID NO: 355517 - DNA, 700 bp, Homo sapiens
  misc_feature: GZ8MTXP02F9UNI.44.6.A06.1.454.CMB.2.raw
  modified_base (216)..(216): a, c, t, g, unknown or other
  misc_feature (216)..(216): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtcgtacccctttcngcacggcctcgtggaagtactacctacgttccacttacttactaccatcaacgtggtgccgccacggcccctggacaaggcttgagtgagtgggtaggaactcgacttcccctttgttttcggctactacctctaccctagcacgacgtacccgttccggggacagtaacttacggacttaccggcggactaacgtaccacgacgacacgtacgtcctaccgatacgaactaatcgtaacgtttcttagaaacccttccgaacgtacccgtaccgggtacccttacttaaccgttaccgtaggttacggccgaacggttcccgggtaacccccgttaccccgaagtcccgtaccggactacgggttaccggtaacgttcccgttttagggaaaccggttcggttacggggtacgggggccgtaaacccgggggtaacccgttcggggttacttaacggttccggtcctaacccgttcgtacccg

SEQ ID NO: 355518 - DNA, 686 bp, Homo sapiens
  misc_feature: GZ8MTXP02FKRIS.44.6.A06.1.454.CMB.2.raw
  modified_base (217)..(217): a, c, t, g, unknown or other
  misc_feature (217)..(217): n is a, c, g, or t
  modified_base (275)..(275): a, c, t, g, unknown or other
  misc_feature (275)..(275): n is a, c, g, or t
  modified_base (286)..(286): a, c, t, g, unknown or other
  misc_feature (286)..(286): n is a, c, g, or t
  modified_base (303)..(303): a, c, t, g, unknown or other
  misc_feature (303)..(303): n is a, c, g, or t
  modified_base (339)..(339): a, c, t, g, unknown or other
  misc_feature (339)..(339): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaacgtggtgcagtctgggactagaatcgccgcaaccttggtccctggtctaccctttccngcaccggctctaggaatacctactacgttccactacttataccatcaagtgggtgccnccgacgccccnggacaggctggcgtagngtggtgaatctactccttcgttttcgctctactacncctacgcacgagtaccccgttaccggggcagtaacgttacgaacttaccggcgaacgaacgtccaacaacgacaaaccgtacgtcctaccgtaatacggtaacctaagttgtacgttttcgttaacgaaacgttccggaaacccgtaccgtaccgggtccccgttacgttaacccgttacgttacgggttaccggacgtaaccggaaccgggttcccccgaccccgttaggaccctccgtgtaccgtaggtaccgtcccgtttaggacgttaacggtccggggtacggggaccgttaacgggggtaaccctagggtacctacgttacgtccgaaaccgtctaaccgg

SEQ ID NO: 355519 - DNA, 683 bp, Homo sapiens
  misc_feature: GZ8MTXP02GPLPY.44.6.A06.1.454.CMB.2.raw
  modified_base (216)..(216): a, c, t, g, unknown or other
  misc_feature (216)..(216): n is a, c, g, or t
  modified_base (373)..(373): a, c, t, g, unknown or other
  misc_feature (373)..(373): n is a, c, g, or t
  modified_base (450)..(450): a, c, t, g, unknown or other
  misc_feature (450)..(450): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgtaactggtgcagtcgtgggactagatgccgcaaccttggtcctcggtcgtaccctttccngcgacggcctcgtaggaacgtacctaccacgttacccacttacttactacctatacctaacgtgggtcgccgcccgacggccccgtagggacgaacgggtcttggagtggagtgggtagactctacttccctttcgtttgctcctctactacctacncgacgagtaccgtccggacagtactacgacgttaccgcggacaacgtcccaagacgacacgtacgtacctccgtaanacgtaacaagttagtacgtttacttacgaacgttacccgacgtacccgacggttcccgtacttactaaccgttgtacggacggtaccgtaccggtaccccgtaaccgtcgtccgtacgtacacggttgggaccttcggtttggacgttacggttaccggggcgggggtaaccgtacccgggttacggttaacggtcgtaacgtttccgtaccgactttaccgacttaccccgg

SEQ ID NO: 355520 - DNA, 556 bp, Homo sapiens
  misc_feature: GZ8MTXP02I11P0.44.6.A06.1.454.CMB.2.raw
  modified_base (268)..(268): a, c, t, g, unknown or other
  misc_feature (268)..(268): n is a, c, g, or t
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
  modified_base (433)..(433): a, c, t, g, unknown or other
  misc_feature (433)..(433): n is a, c, g, or t
tcagacagtatatacacgaccggtgctcgatttagatctactgacaaccacattcctcctctaaagaagcccctgggagcacagctcatcaccatggactggacctggaggttcctctttgtggtggcagcagcaacaggtgtccagtccctggtgcaactggtgcagtctgggactagaatgccgcaaccttggtcctcggtgaccccttttcctgccacggcctctggaagtctaccagttccactacttataccatcaactggtncgccagcccctgacaaggctgagtgatggnggatcatccctnttttggctcactcacctacgcacgagaccttccggggcagaattacgattaccgcggtacaacggtccacacgacacagtctccatgacaagtcgagttcttgaaatccgaacacacggcctntactactcgtgacgagacgtccgtacccacgctacgcacgtggacgtcctttacggacgtatccggtaggggccgtaagggaaccccgtgggttaccagtttgtacccgtaaccgttcgtacg

SEQ ID NO: 355521 - DNA, 528 bp, Homo sapiens
  misc_feature: GZ8MTXP01ER7JX.52.71.G05.1.454.CMB.2.raw
  modified_base (304)..(304): a, c, t, g, unknown or other
  misc_feature (304)..(304): n is a, c, g, or t
  modified_base (333)..(333): a, c, t, g, unknown or other
  misc_feature (333)..(333): n is a, c, g, or t
  modified_base (371)..(371): a, c, t, g, unknown or other
  misc_feature (371)..(371): n is a, c, g, or t
  modified_base (439)..(439): a, c, t, g, unknown or other
  misc_feature (439)..(439): n is a, c, g, or t
  modified_base (492)..(492): a, c, t, g, unknown or other
  misc_feature (492)..(492): n is a, c, g, or t
tcagcgcagtacgacacgaccggtgctcgatttagtgtcgtcgcaagagagagggggggtgagggttgagaacctatgaacattctgtaggggccactgtcttctcctcggactccttgcttatggatcaggagtggattctcagactgtggtgacccaggagccatcgttctcagtgtcccctggagggacagtcacactcacttgtggcttgagctctggctcagtctctctaattctacccagctggtaccagcagaccccaggccaggctccacgcacgctcatctacagcacaattacncgctcttctggggtccctgatcgcttccnctggctccatcccttagggaacaaagctgaccctaacntcgacggggcccaggcagatgatagaatctagattattactgtcgtcctatagtagtgggtagtcggntagtttggattggttcggacggagggaacccaagcgtgaccgtcgtgggttcncgccgaaggcctcgcccctggcctaacgttctcccg

SEQ ID NO: 355522 - DNA, 562 bp, Homo sapiens
  misc_feature: GZ8MTXP01EFPWR.52.71.G05.1.454.CMB.2.raw
  modified_base (312)..(312): a, c, t, g, unknown or other
  misc_feature (312)..(312): n is a, c, g, or t
  modified_base (385)..(385): a, c, t, g, unknown or other
  misc_feature (385)..(385): n is a, c, g, or t
tcagcgcagtacgacacgaccggtgctcgatttagtgtcgtcgcaagagagaggggggggtgagggttgagaacctatgaacattctgtagggccactgtcttctcttcggactccttgcttatggatcaggagtggattctcagactgtggtgacccaggagccatcgttctcagtgtccccctggagggacagtcacactcacttgtggcttgagctctggctcagtctctcctaatttccacccagctgtaccagcacgaccccaggccaggcctccacgcacgctcatctacagccaactaaattacncgctcctttcgtcgggggtccctgactcgcttccctctgctccatcccttagggaacaaagctcgccctaacntcgacggggccagcagatgatagaatctagtattattactgtcgttccgtcttagtagttgggtagtgctagtttggattggtcggcggacggaaccaagttcgtcgaccgtcgtcgggttcgcgaccccgaaggcctccgtcccccgtacggttcctaaccgttccgttaaccccg

SEQ ID NO: 355523 - DNA, 553 bp, Homo sapiens
  misc_feature: GZ8MTXP01ETN4N.52.71.G05.1.454.CMB.2.raw
  modified_base (249)..(249): a, c, t, g, unknown or other
  misc_feature (249)..(249): n is a, c, g, or t
  modified_base (265)..(265): a, c, t, g, unknown or other
  misc_feature (265)..(265): n is a, c, g, or t
  modified_base (293)..(293): a, c, t, g, unknown or other
  misc_feature (293)..(293): n is a, c, g, or t
  modified_base (439)..(439): a, c, t, g, unknown or other
  misc_feature (439)..(439): n is a, c, g, or t
tcagcgcagtacgacacgaccggtgctcgatttagtgtcgtcgcaagagagagggggggggtgagggttgagaacctatgaacattctgtaggggccactgtcttctcctcggactccttgcttatggatcaggagtggattctcagactgtggtgacccaggagccatcgttctcagtgtcccctggagggacagtcacactcacttgtggcttgagctctggctcagtctctcctaattctacccanctgacagcagaccccngccaggctccacgcacgctcatctacancaacaattactcgctcttcgtcggggtccctgactcgcttcctctgcctccactacccgttagggaacctaaagctaccgacccctaaaccacgtccgaccgggggcccaggcagatgatgaatctagtattatactgttctcctnttatagtggtagtgctagttgatggtcggcggaggaacaagttcgtcgacccgtcgtcgggttcgcgacccgtaaggcctccgcccccgtcggttcctaaccttccgttccccg

SEQ ID NO: 355524 - DNA, 615 bp, Homo sapiens
  misc_feature: GZ8MTXP01DOMGK.52.71.G05.1.454.CMB.2.raw
  modified_base (394)..(394): a, c, t, g, unknown or other
  misc_feature (394)..(394): n is a, c, g, or t
  modified_base (420)..(420): a, c, t, g, unknown or other
  misc_feature (420)..(420): n is a, c, g, or t
tcagcgcagtacgacacgaccggtgctcgatttagtgtcgtcgcaagagagaggggggggtgagggttgagaacctatgaacattctgtaggggccactgtcttctcctcggactccttgcttatggatcaggagtggattctcagactgtggtgacccaggagccatcgttctcagtcgtcccctggagggacagtcacactcacttgtggcttgagctctggctcagtctctcctaatttccacccagctggtaccagcacgaccccagccaggcctccacgcacgctcactctacagcaactaattactcgtcttcctttcgtcggggtccctgactcgtcttcctctgcctccactcccgttagggaacaagtcctaccgacccctaacncgtaccgggaccggggcccaggcagntagatagattctagtattacttactgtcgttccttattagttgtagggtagtgcgttagtttggtacgttcgggttacggacgggacgggtaactaacggttcgtaccggttacccgttccggtcggttccgccggacccgtaacgggtccctcccggtccccgtcggttccctaaccgttcccgtttaaccccg

SEQ ID NO: 355525 - DNA, 610 bp, Homo sapiens
  misc_feature: GZ8MTXP01DE7Y5.52.71.G05.1.454.CMB.2.raw
  modified_base (313)..(313): a, c, t, g, unknown or other
  misc_feature (313)..(313): n is a, c, g, or t
  modified_base (325)..(325): a, c, t, g, unknown or other
  misc_feature (325)..(325): n is a, c, g, or t
  modified_base (387)..(387): a, c, t, g, unknown or other
  misc_feature (387)..(387): n is a, c, g, or t
tcagcgcagtacgacacgaccggtgctcgatttagtgtcgtcgcaagagagaggggggggtgagggttgagaacctatgaacattctgtaggggccactgtcttctcctcggactccttgcttatggatcaggagtggattctcagactgtggtgacccaggagccatcgttctcagtcgtcccctgggagggacagtcacactcacttgtggcttgagctctggctcagtctctcctaattcctaccccagctggtaccagcacgaccccaggccaggcctccacgcacgctcatctacagcaacaattacncgcttctttcgngggggtccctgactcgcttcctctgctccatccgttagggaacaaagctacgacccctaacncgtccgacggggcccaggcagatgatagaagtctagtatttatactgttacgtcctacttagtagttgggtagtggtcttagtttaggagttcgggttacgggacgggtacgggaaccgtaaggttccgtacggacccggttccgtcggggttaccgacggaccccgtaagggtccctccggtccccccgtcgggttaccctaacccgttccgtttcccccgg

SEQ ID NO: 355526 - DNA, 546 bp, Homo sapiens
  misc_feature: GZ8MTXP01ESRFC.52.71.G05.1.454.CMB.2.raw
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
tcagcgcagtacgacacgaccggtgctcgatttagtgtcgtcgcaagagagaggggtgagggttgagaacctatgaacattctgtaggggccactgtcttctcctcggactccttgcttatggatcaggagtggattctcagactgtggtgacccaggagccatcgttctcagtgtcccctggagggacagtcacactcacttgtggcttgagctctggctcagtctctcctaattctacccagctgtacngcacgaccccnggccaggctccacgcacgctcatctacagacaacaattactcgtcttcctttcgtcggggtccctgactcgtcttccctctggcctccacttccgttagggaacaaagtctaccgacccctaacacgtccgaccggggcccaggcagactgatagaatctagtattatactgtctcctcttatagtggtagtgtctagttgatggtcgggcggagggaacagcgtcgaccgtcgtcggcgcgacccgaaggcctccgtccccgtcggcctccgttccgttcccg

SEQ ID NO: 355527 - DNA, 572 bp, Homo sapiens
  misc_feature: GZ8MTXP01EAUTH.52.71.G05.1.454.CMB.2.raw
  modified_base (256)..(256): a, c, t, g, unknown or other
  misc_feature (256)..(256): n is a, c, g, or t
  modified_base (309)..(309): a, c, t, g, unknown or other
  misc_feature (309)..(309): n is a, c, g, or t
  modified_base (391)..(391): a, c, t, g, unknown or other
  misc_feature (391)..(391): n is a, c, g, or t
  modified_base (475)..(475): a, c, t, g, unknown or other
  misc_feature (475)..(475): n is a, c, g, or t
tcagcgcagtacgacacgaccggtgctcgatttagtgtcgtcgcaagagagaggggtgagggttgagaacctatgaacattctgtaggggccactgtcttctcctcggactccttgcttatggatcaggagtggattctcagactgtggtgacccaggagccatcgttctcagtgtccccctgggagggacagtcacactcacttgtggcttgagctctgctcagtctctcctaatttcctacccagctgtaccancacgacccagccaggcctccacgcacgctcatctacagacaactaaatttacnccgtcttctttcgtcggggtccctgactcgctttcctctgcctccacgttcccgtagggaacaagtcctacgacccctaacncgtcggaccggggcccaggacagatacgatagaattctagtaattattctgttctccttatatagtgggtagtgtctgtttagngttcggttacggcggagggaaccaaggcgtcgaccgtccgtgggttccgcgaccgaacgccgtcccgtccccgtcggttctaaccgttccgttcccg

SEQ ID NO: 355528 - DNA, 568 bp, Homo sapiens
  misc_feature: GZ8MTXP01DWRLA.52.71.G05.1.454.CMB.2.raw
  modified_base (311)..(311): a, c, t, g, unknown or other
  misc_feature (311)..(311): n is a, c, g, or t
  modified_base (428)..(428): a, c, t, g, unknown or other
  misc_feature (428)..(428): n is a, c, g, or t
  modified_base (471)..(471): a, c, t, g, unknown or other
  misc_feature (471)..(471): n is a, c, g, or t
  modified_base (481)..(481): a, c, t, g, unknown or other
  misc_feature (481)..(481): n is a, c, g, or t
  modified_base (518)..(518): a, c, t, g, unknown or other
  misc_feature (518)..(518): n is a, c, g, or t
tcagcgcagtacgacacgaccggtgctcgatttagtgtcgtcgcaagagagaggggtgagggttgagaacctatgaacattctgtaggggccactgtcttctcctcggactccttgcttatggatcaggagtggattctcagactgtggtgacccaggagccatcgttctcagtgtcccctggagggacagtcacactcacttgtggcttgagctctggctcagtctctcctaatttcctacccagctggtaccagcacgaccccaggccaggcctccacgccaccgctcactctacagcaactaattacncgtctcttcgtcggggtccctgactcgctttcctctgcctcctatcccgttaagggaaccaaagtcctacgacccctaaccagtccggacccggggccctaggcagatgatagactntagattatactgtcgtcctatatagtgggtatgtctgtttagngttggtcggngggacggaactagttcgtcgaccgtcgtgggttaccncggacccgaacgggcctccgtccccgtgttccctaacgttccgttccccg

SEQ ID NO: 355529 - DNA, 613 bp, Homo sapiens
  misc_feature: GZ8MTXP01ELEA9.52.71.G05.1.454.CMB.2.raw
tcagcgcagtacgacacgaccggtgctcgatttagtgtcgtcgcaagagagaggggggggtgagggttgagaacctatgaacattctgtaggggccactgtcttctcctcggactccttgcttatggatcaggagtggattctcagactgtggtgacccaggagccatcgttctcagtgtcccctggagggacagtcacactcacttgtggcttgagctctggctcagtctctcctaatttcctaccccagctggtaccagcacgaccccaggccaggctccacgcacgctcatcctacagcactaattactcgctcttcgtcggggtccctgactcgcttcctctggcctcctacttacccgttagggaactaaagcctacgacccctaaaccagtccgaccgggggcccaggacagatgatagaatctagattagtacttgtcgttcgttctagttagtgggtagtgtcgttagtttaggagttgggttcgggacggggtagggaacccgtaaaggttccgtacggttcccgtccggtcggggttaccacggccccggaacggtccgtcccggtcccccgtcgggttaccctaacccgttcgtttcccccg

SEQ ID NO: 355530 - DNA, 598 bp, Homo sapiens
  misc_feature: GZ8MTXP01EPG0Z.52.71.G05.1.454.CMB.2.raw
  modified_base (298)..(298): a, c, t, g, unknown or other
  misc_feature (298)..(298): n is a, c, g, or t
  modified_base (309)..(309): a, c, t, g, unknown or other
  misc_feature (309)..(309): n is a, c, g, or t
  modified_base (344)..(344): a, c, t, g, unknown or other
  misc_feature (344)..(344): n is a, c, g, or t
  modified_base (393)..(393): a, c, t, g, unknown or other
  misc_feature (393)..(393): n is a, c, g, or t
tcagcgcagtacgacacgaccggtgctcgatttagtgtcgtcgcaagagagaggggggggtgagggttgagaacctatgaacattctgtagggccactgtcttctcctcggactccttgcttatggatcaggagtggattctcagactgtggtgacccaggagccatcgttctcagtgtcccctgggagggacagtcacactcacttgtggcttgagctctggctcagtctctcctaattccacccagctggtaccagcacgaccccaggccaggcctccacgcacgctcatctacancactaattacncgctctttcgtcggggtccctgactcgtctttccnctcggctccacttcccgttagggaacaaacgccttcgacccctaaaccncgtccggaccggggcccaggcaggatgatagaatctagtattacttactgttcgttccttatagttagtgggttagtcggtgttaagtttggagttcgggttacgggacgggagggaaccgtaacgccgtcggttacccgttcggtacgggttcgacgccccgtaaggccctccgcccccgtggttaccctccgttccttccccg

SEQ ID NO: 355531 - DNA, 610 bp, Homo sapiens
  misc_feature: GZ8MTXP01CJN5W.52.71.G05.1.454.CMB.2.raw
  modified_base (222)..(222): a, c, t, g, unknown or other
  misc_feature (222)..(222): n is a, c, g, or t
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (415)..(415): a, c, t, g, unknown or other
  misc_feature (415)..(415): n is a, c, g, or t
tcagcgcagtacgacacgaccggtgctcgatttagtgtcgtcgcaagagagaggggtgagggttgagaacctatgaacattctgtaggggccactgtcttctcctcggactccttgcttatggatcaggagtggattctcagactgtggtgacccaggagccatcgttctcagtcgtccctggagggacagtcacactcacttgtgcttgagctctggcctnagttctcttccttaattcctacccagctggtaccagcacgacccnggccaggcnccacgcacgctcatctacagcaataacttactcgctcgttcgtcgggtccctagctcgtcttcctctagcctcactccgttagggaacctaaagctacgacccctaacgacgtcgaccggggccaggctaggatgatanacgtatgtaattattagtcgttacttccttatatgtagggttaccgtggtactagttttcggattcggggttacggacgggtacgggaaccctaagttccgttaaacggcccgtcggtacggttcccgacggttccccgaaacgccccggttccgtccccccggtacggttacccttcttccccggttttccccg

SEQ ID NO: 355532 - DNA, 492 bp, Homo sapiens
  misc_feature: GZ8MTXP02JAKGW.52.71.G05.1.454.CMB.2.raw
  modified_base (465)..(465): a, c, t, g, unknown or other
  misc_feature (465)..(465): n is a, c, g, or t
tcagcgcagtacgacacgaccggtgctcgatttagtgtcgtcgcaagagagagggggtgagggttgagaacctatgaacattctgtagggccactgtcttctcctcggactccttgcttatggatcaggagtggattctcagactgtggtgacccaggagccatcgttctcagtgtcccctggagggacagtcacactcacttgtggcttgagctctggctcagtctctcctaatttctacccagctggtaccagcagaccccaggccaggctccacgcacgctcatctacagcacaattactcgctcttctggggtccctgatcgcttcctctgctccatccttgggacaagctgccctaacatcgacggggcccaggcagatgatgaatctgattattactgtgtcctctatatgggtatggcatttggatgttcggcgagggaccagctgaccgtctggtcngccaaggctcgcccctggtcactctcg

SEQ ID NO: 355533 - DNA, 547 bp, Homo sapiens
  misc_feature: GZ8MTXP02F73MD.52.71.G05.1.454.CMB.2.raw
  modified_base (426)..(426): a, c, t, g, unknown or other
  misc_feature (426)..(426): n is a, c, g, or t
tcagcgcagtacgacacgaccggtgctcgatttagtgtcgtcgcaagagagagggggggtgagggttgagaacctatgaacattctgtaggggccactgtcttctcctcggactccttgcttatggatcaggagtggattctcagactgtggtgacccaggagccatcgttctcagtcgtcccctggagggacagtcacactcacttgtggcttgagctctggctcagtctctcctaatttcacccagctgtaccagcagaccccaggccaggctccacgcacgctcatctacagcacattactcgctcttcgtggggtccctgatcgcttcctctgctccatccgttagggaacaaacgctacgacccctaaccagtccgaccgggggcccaggccagatgatgaatctagtattattacgtgtnttcctatatagtgggtatggctagtttgagtgttcgggacggaggtaccgaagtcgtacgacccggtcgtcggtcacggtcccgaagccgtccgtccccgtcgtcctacgtcgttaccccg

SEQ ID NO: 355534 - DNA, 563 bp, Homo sapiens
  misc_feature: GZ8MTXP02IWXO5.52.71.G05.1.454.CMB.2.raw
  modified_base (304)..(304): a, c, t, g, unknown or other
  misc_feature (304)..(304): n is a, c, g, or t
tcagcgcagtacgacacgaccggtgctcgatttagtgtcgtcgcaagagagaggggtgagggttgagaacctatgaacattctgtaggggccactgtcttctcctcggactccttgcttatggatcaggagtggattctcagactgtggtgacccaggagccatcgttctcagtgtcccctggagggacagtcacactcacttgtggcttgagctctggctcagtctctcctaattctaccccagctggtaccagcacgaccccaggccaggctccacgcacgctcatctacagcacaattacncgcttcttctggggtcccctgatcgcttcctctcgctccattcccgttaggggacaaagtcctcgaccccctaaccactccgaccgggggcccaggccagatgatgaatctagtattatactgtgtcctcttatagtgggtagtggctagtttggagttggttcgggcggtacgggaccaaggctacggacccgttccgtcgggtaccacggacccgtaacggccgtccgcccccgtcggtaccacgttccgttacccg

SEQ ID NO: 355535 - DNA, 665 bp, Homo sapiens
  misc_feature: GZ8MTXP02ILLV1.52.71.G05.1.454.CMB.2.raw
tcagcgcagtacgacacgaccggtgctcgatttagtgtcgtcgcaagagagaggggggctctgagagaggagcccagccctgggattttcaggtgttttcatttggtgatcaggactgaacagagagaaatcaccatggagtttgggctgagctggctttttcttgtggctattttaaaaggtggccaatgtgaggtgcagctggtggagtcgtgggggagcgttggtacaggcccgggggtcctgagactctcctgtgcagcctctggtattcagttttaccagtctatgccagtggccctgggtcccgccaggctccgaggggaaggggctggagtgggtctcgaggtattaggtgtagtgctatcgaccactatcgtacgcagacctccgtaggaaacgggtcccggttacacctactttcccgaagaacgaactaaacgttacccaaagtacttaaccccgtgtaactcgtagtaacaaaagttagaaacctacgacccgtaggaacgaccggaccggaaacggaaccgtaaaccggggccgttaaacgttaactttaacggttacggttacgaacggaaaacgtaccgtaaaactttaaccgtaccttaaagtacggtaaaccttaagtttaacgtccgggtaccctaaagtttaaccgg

SEQ ID NO: 355536 - DNA, 617 bp, Homo sapiens
  misc_feature: GZ8MTXP02F8K9K.52.71.G05.1.454.CMB.2.raw
  modified_base (500)..(500): a, c, t, g, unknown or other
  misc_feature (500)..(500): n is a, c, g, or t
tcagcgcagtacgacacgaccggtgctcgatttagtgtcgtcgcaagagagagggggggtgagggttgagaacctatgaacattctgtagggccactgtcttctcctcggactccttgcttatggatcaggagtggattctcagactgtggtgacccaggagccatcgttctcagtcgtcccctggagggacagtcacactcacttgtggcttgagctctggctcagtctctcctaatttcctacccagctggtaccagcacgaccccaggccaggcctccacgccacgctcatctacacgacaactaattacctcgccttcttccgtcggggttacccctgactccgtctttcctcctcggcctccctattcccgttaggggaaccaaaggccttacgaccccctaaaccacgtaccggacccgggggacccagggccagatgatacgaatctagtattattacgttgtcgtccttcttaagtattaggggttagtggnttagtttggtagttggttcgggcgggacgggaaccaaggtcgttacggaccgttccgttcgggcacggcccgaacgggtcctaccggcccccttcggtcctacccgtctttccccgg

SEQ ID NO: 355537 - DNA, 537 bp, Homo sapiens
  misc_feature: GZ8MTXP02JRJAB.52.71.G05.1.454.CMB.2.raw
  modified_base (301)..(301): a, c, t, g, unknown or other
  misc_feature (301)..(301): n is a, c, g, or t
  modified_base (330)..(330): a, c, t, g, unknown or other
  misc_feature (330)..(330): n is a, c, g, or t
  modified_base (524)..(524): a, c, t, g, unknown or other
  misc_feature (524)..(524): n is a, c, g, or t
tcagcgcagtacgacacgaccggtgctcgatttagtgtcgtcgcaagagagagggtgagggttgagaacctatgaacattctgtagggccactgtcttctcctcggactccttgcttatggatcaggagtggattctcagactgtggtgacccaggagccatcgttctcagtgtcccctggagggacagtcacactcacttgtggcttgagctctggctcagtctctcctaatttctaccccagctggtaccagcacgaccccagccaggctccacgcacgctcatcacagcacaattacncgctcttctggggtccctgactcgcttcnctgctccatccttagggacaaagctacgccctaacatcgaccgggggcccaggcagatgatgaatctagtattatactgttgtcctctatagtgggtagtgctatttggatggttcgggcggagggtaccaagcgttacggaccgttccgttcgggccacgacccgaacggtcctccggtcccccgtggtaccnccttctttccccg

SEQ ID NO: 355538 - DNA, 626 bp, Homo sapiens
  misc_feature: GZ8MTXP02JP73N.52.71.G05.1.454.CMB.2.raw
  modified_base (264)..(264): a, c, t, g, unknown or other
  misc_feature (264)..(264): n is a, c, g, or t
  modified_base (287)..(287): a, c, t, g, unknown or other
  misc_feature (287)..(287): n is a, c, g, or t
tcagcgcagtacgacacgaccggtgctcgatttagtgtcgtcgcaagagagagggggctctgagagaggagcccagccctgggattttcaggtgttttcatttggtgatcaggactgaacagagagaaatcaccatggagtttgggctgagcgtggtcttttctgtggctattttaaaaggtggccaatgtgaggtgcagctggtggagtcgtgggggagcttggtacaggcccgggggtcctgagctctcctgtgcagccctntggattcagttttaccagcttancgcagtcgcgtcggccgcgacgccgtacggagggacggtcgtggtaggtcggtctacgtaggttagttaggtggtacgtgtactacgtacgacctactacgttccgacgacacgtaccgtcggtacggtaccgggtcccgttacacctacgttacgaagtacgaactaacgtaaccgtaacgtaacgtaccgtacgtactacgtacgtaacgtaactaacgaacgacgtacgtacgacgacgaccgacgacgacgtacgtacgtacgtacgtacgtacgacgaacgtactaacttactacgtaacgtacgtacgtacgtacgtacgtaccgtacgtacg

SEQ ID NO: 355539 - DNA, 540 bp, Homo sapiens
  misc_feature: GZ8MTXP02GD3MS.52.71.G05.1.454.CMB.2.raw
  modified_base (260)..(260): a, c, t, g, unknown or other
  misc_feature (260)..(260): n is a, c, g, or t
  modified_base (318)..(318): a, c, t, g, unknown or other
  misc_feature (318)..(318): n is a, c, g, or t
  modified_base (451)..(451): a, c, t, g, unknown or other
  misc_feature (451)..(451): n is a, c, g, or t
  modified_base (467)..(467): a, c, t, g, unknown or other
  misc_feature (467)..(467): n is a, c, g, or t
  modified_base (498)..(498): a, c, t, g, unknown or other
  misc_feature (498)..(498): n is a, c, g, or t
tcagcgcagtacgacacgaccggtgctcgatttagtgtcgtcgcaagagagaggggtgagggttgagaacctatgaacattctgtaggggccactgtcttctcctcggactccttgcttatggatcaggagtggattctcagactgtggtgacccaggagccatcgttctcagtgtcccctggagggacagtcacactcacttgtggcttgagctctgctcagtctctctaattcacccagctggtacagcacgaccccngccagctccacgcacgctcatctacagcaacaattactcgctcttcgtcggggtcccngactcgcttcctctcgctccattcccgttagggaacaaacgctacgacccctaaccagtccggacccgggggccaggcagatgatagaatctagtattattactgtcgttccctattagtagtgggtagtcgntagttgattggtcggnggaggaccaggctacgtccgtcgtcggtacncggaccgaaggtcctcgtccccgtcggtcctcttcgttcccg

SEQ ID NO: 355540 - DNA, 666 bp, Homo sapiens
  misc_feature: GZ8MTXP02HYU37.52.71.G05.1.454.CMB.2.raw
  modified_base (299)..(299): a, c, t, g, unknown or other
  misc_feature (299)..(299): n is a, c, g, or t
tcagcgcagtacgacacgaccggtgctcgatttagtgtcgtcgcaagagagaggggggggtgagggttgagaacctatgaacattctgtaggggccactgtcttctcctcggactccttgcttatggatcaggagtggattctcagactgtggtgacccaggagccatcgttctcagtgtcccctggagggacagtcacactcacttgtggcttgagctctggctcagtctctcctaatttctaccccagctggtaccagcacgaccccaggccaggctccacgcacgctcatcctacngcaactaattactcgcttcttcgtcggggtccctgtactcgtcttcctcgtcgtcctcctattcccgttagggaaccaaacgtcctaccgaccccctaaacctacgtaccgaccgggggacccaaggtagacgtgtaactagaacttcgtagtaatttacttacgtcgttcgttcccttattaagtttaggtagggggtttaacggtggttacgttaaggttttgggtaagtttcgggttaccggggacggggtaacggggtaaccaacggtccgtacgggtacccgttccggtacgggtccaccggacccgaacgggtcctcccggtacccccgtcggtaccctaccttccgttacccgttccccc

SEQ ID NO: 355541 - DNA, 586 bp, Homo sapiens
  misc_feature: GZ8MTXP02GO44L.52.71.G05.1.454.CMB.2.raw
  modified_base (555)..(555): a, c, t, g, unknown or other
  misc_feature (555)..(555): n is a, c, g, or t
tcagcgcagtacgacacgaccggtgctcgatttagtgtcgtcgcaagagagaggggggctctgagagaggagcccagccctgggattttcaggtgttttcatttggtgatcaggactgaacagagagaaatcaccatggagtttgggctgagcgtggtcttttctgtggctatttaaaggtgccaatgtgaggtgcagctggtggagtcgtgggggagcttggtacaggcccgggggtcctgagactctcctgtgcagcctctggattctacgtttaccagtctatcgccagtcggccgtgggtccccgccgaggccgtccgaaggggaggggtcgtgggaggttggggtctcgaggttataggtggtagtgctatcgacctactattccgacgacacgtacctccggtaggaacgggtcccgttacacgttcttaccgagacgaactataccaagtcgtacctgtactctgaacaagtacacgtacgccagacgacgaccgaacgtacgaccgggtacttattaacttcgtgcgaaccgagactaacttacctntaagtgaactagttgacggacctattaccgg

SEQ ID NO: 355542 - DNA, 560 bp, Homo sapiens
  misc_feature: GZ8MTXP02G54N1.52.71.G05.1.454.CMB.2.raw
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
tcagcgcagtacgacacgaccggtgctcgatttagtgtcgtcgcaagagagaggggtgagggttgagaacctatgaacattctgtaggggccactgtcttctcctcggactccttgcttatggatcaggagtggattctcagactgtggtgacccaggagccatcgttctcagtcgtcccctggagggacagtcacactcacttgtggcttgagctctggctcagtctctcctaatttctaccccagctggtaccagcacgaccccaggccaggcctccacgcacgctcatctacagcaacaattacctcgctcttctggggtcccctgactcgcttcctctgctccatccgttagggaacaaacgctacgaccctaaccatccgaccgggggcccagccagatgatgaatcngtatattactgtntctctatagtgggtagtgctatttggattggttcggacggaggaacccgaagtctacggtacccgttcgtcggggtaccacgacccgaaggtccgtcccgtcccccgtcggtaccctccgttccgtttcccccg

SEQ ID NO: 355543 - DNA, 689 bp, Homo sapiens
  misc_feature: GZ8MTXP02JDFVJ.52.71.G05.1.454.CMB.2.raw
  modified_base (226)..(226): a, c, t, g, unknown or other
  misc_feature (226)..(226): n is a, c, g, or t
  modified_base (262)..(262): a, c, t, g, unknown or other
  misc_feature (262)..(262): n is a, c, g, or t
  modified_base (302)..(302): a, c, t, g, unknown or other
  misc_feature (302)..(302): n is a, c, g, or t
tcagcgcagtacgacacgaccggtgctcgatttagtgtcgtcgcaagagagaggggggggtgagggttgagaacctatgaacattctgtaggggccactgtcttctcctcggactccttgcttatggatcaggagtggattctcagactgtggtgacccaggagccatcgttctcagtgtcccctggagggacagtcacactcacttgtggcttgagctctggctnagtctctctattcacccagctgtacagcacgacccngccaggctccacgcacgctcatctacacgacacaattacncgcttcttcggtcgggtcccctgactcgtctttccgtcgtgcctcctacttccggttagggaaccaaagtcctaccggaccccctaacgacgtaccgggaacccgggggcccagggacccaagtactacggatacggaacttcgtacgttaactttacttacgttggttacgttcccttacgtttaagttacggtttagggggttaaggtcgttaacgttaggttttagggtaacgtttgggggttaaccggggtacggggtaacggggaacccgtaaaggtccgttaccgggtacccggttaccggtcggggttaccgaacggacccgtaacgggtcccgtacccggtcccccggtcgtaccccgttaccgttcccgtttcccccg

SEQ ID NO: 355544 - DNA, 615 bp, Homo sapiens
  misc_feature: GZ8MTXP02IXR84.52.71.G05.1.454.CMB.2.raw
  modified_base (392)..(392): a, c, t, g, unknown or other
  misc_feature (392)..(392): n is a, c, g, or t
tcagcgcagtacgacacgaccggtgctcgatttagtgtcgtcgcaagagagaggggtgagggttgagaacctatgaacattctgtaggggccactgtcttctcctcggactccttgcttatggatcaggagtggattctcagactgtggtgacccaggagccatcgttctcagtcgtcccctggagggacagtcacactcacttgtggcttgagctctggctcagtctctcctaattcctacccagctgtaccagcacgaccccagccagctccacgcacgctcatctacagcaacaattacctcgcttcttcgtggggtcccctgactcgtcttcctctcggcctccacttcccgttagggaacctaaagccttacgacccccttaaaccnctaccggaccgggggcccagggccagatgaatgaatctagtaacttattacttgttcgttcccttattatagttggggttaagtcggtattagtttggtagttcggttacgggtcggggaacggtaccgaagcgtaccggtacccggttccgtacggggtcaaccggaccgtaaacggtcccgtccggtccccccgtcggtacctaccgttcgtttcccccgg

SEQ ID NO: 355545 - DNA, 671 bp, Homo sapiens
  misc_feature: GZ8MTXP02G0LTC.52.71.G05.1.454.CMB.2.raw
tcagcgcagtacgacacgaccggtgctcgatttagtgtcgtcgcaagagagaggggggctctgagagaggagcccagccctgggattttcaggtgttttcatttggtgatcaggactgaacagagagaaatcaccatggagtttgggctgagctggtctttttcttgtggcttaattttaaaaggtggccaatggtgaggtgcagcgtggtggagtcgtgggggagcgttggtacgacggccccgggggtcctgacgtactctcctgtgcacgcctcgtggtattctacgtttaccagtctaaaatcgaccagtcggtccgtcggtcccgccgacggcgtaccggagggacgggcgtggacggtcggtcgtcgtaggtacgttaggtggtagtcgtactagtacgtaccacgtacttccgtacgacgacgtaccgtccgtaggaacggtccgttaccacctacttaccgaacgtacgaactaactaccgaaacgtacgtaacccgtagtacttacgtacgtaactaaacgtacgaacgacgtaccgtacgaacgacgaccgacgtaccgaaccgtaccgtaacttacgttacgtaggtacgtacgtaaacgtacgtaaacttactacgtaagtacgtaacgtacgttagtaccggtaccgtacgttaacgg

SEQ ID NO: 355546 - DNA, 603 bp, Homo sapiens
  misc_feature: GZ8MTXP02HOLZL.52.71.G05.1.454.CMB.2.raw
  modified_base (460)..(460): a, c, t, g, unknown or other
  misc_feature (460)..(460): n is a, c, g, or t
tcagcgcagtacgacacgaccggtgctcgatttagtgtcgtcgcaagagagaggggggggtgagggttgagaacctatgaacattctgtaggggccactgtcttctcctcggactccttgcttatggatcaggagtggattctcagactgtggtgacccaggagccatcgttctcagtcgtcccctggagggacagtcacactcacttgtggcttgagctctggctcagtctctctaacttccacccagctgtacagcacgacccaggccaggcctccacgcacgctacatcctacagacaactaacttactccgcttcttcgtcggggtccctgtactcgtcttccctcgtcgtcctcctagtccgttagggacaacgtctcgacccctaacacgtccggaccgggggccaggctagagtcgtatagaattctagtatttacttactgttcgttacctntttagtagttgggtagtgtacttaggttgtagttcgggttacgggacggggacggtacctaggtcgtacggtacccgtacggttcggcgaccggccgtaacggccgtcccggtaccccgtcggtcctccgtttccgttccccc

SEQ ID NO: 355547 - DNA, 694 bp, Homo sapiens
  misc_feature: GZ8MTXP02FL5FO.52.71.G05.1.454.CMB.2.raw
  modified_base (277)..(277): a, c, t, g, unknown or other
  misc_feature (277)..(277): n is a, c, g, or t
  modified_base (402)..(402): a, c, t, g, unknown or other
  misc_feature (402)..(402): n is a, c, g, or t
tcagcgcagtacgacacgaccggtgctcgatttagtgtcgtcgcaagagagaggggtgagggttgagaacctatgaacattctgtaggggccactgtcttctcctcggactccttgcttatggatcaggagtggattctcagactgtggtgacccaggagccatcgttctcagtcgtcccctggagggacagtcacactcacttgtggcttgagctctggctcagtctctcctaatttccaccccagctggtaccagcacgaccccaggccaggccnccacgccacgctcatctacacgacaacaacttacctcgccttcgttcgtcggggtcccctgtatccgtcttccctcgtcgctcctactcccgttagggacaaagtcctacgtaccccttaaaccncgtccggaaacccgggggcccacgggtaccagaacgtcgaagtagaacttctaggttaatttacgtttacgtaggttcgttaccttacgttagttaggttacggggttaggttcgggtattaaggttttggggtagttacggggtttccgggggacgggtaacgggggtaaacccgaaacggtccggtaccggtaacccggttacggtcggggttacccgaccggacccgtaaaccgggtcccgttacccggcccccggttccggtacctaacccgttccgtttaccccccg

SEQ ID NO: 355548 - DNA, 591 bp, Homo sapiens
  misc_feature: GZ8MTXP02IQHWK.52.71.G05.1.454.CMB.2.raw
  modified_base (269)..(269): a, c, t, g, unknown or other
  misc_feature (269)..(269): n is a, c, g, or t
  modified_base (483)..(483): a, c, t, g, unknown or other
  misc_feature (483)..(483): n is a, c, g, or t
tcagcgcagtacgacacgaccggtgctcgatttagtgtcgtcgcaagagagaggggggggtgagggttgagaacctatgaacattctgtaggggccactgtcttctcctcggactccttgcttatggatcaggagtggattctcagactgtggtgacccaggagccatcgttctcagtcgtcccctgggagggacagtcacactcacttgtggcttgagctctggctcagtctcttcctaattcctacccagctggacagcacgacccnggccagcctccacgcctacgctcatcctacacgcctaacaaactttctcgctttcctttcggtcggggttacccctgtactcgtccttccctcgtgcctcattccgttagggacaagctcgaccctaacagtcgaccggggcccaggcagatcgatagtactctagtaattattacgtcgtactttccctagttagtaggtttagggtacgtgngttaaggtttgtagttcggttcgggacgtaggaacgtagctaacggccggttcgtacgggtccacggaccgaacgtccgtccgtcccccgtgtctaccttcgttcccg

SEQ ID NO: 355549 - DNA, 619 bp, Homo sapiens
  misc_feature: GZ8MTXP02F42F3.52.71.G05.1.454.CMB.2.raw
  modified_base (283)..(283): a, c, t, g, unknown or other
  misc_feature (283)..(283): n is a, c, g, or t
  modified_base (562)..(562): a, c, t, g, unknown or other
  misc_feature (562)..(562): n is a, c, g, or t
tcagcgcagtacgacacgaccggtgctcgatttagtgtcgtcgcaagagagaggggggctctgagagaggagcccagccctgggattttcaggtgttttcatttggtgatcaggactgaacagagagaaatcaccatggagtttgggctgagctggtcttttcttgtggctaatttaaaaggtgccaatgtgaggtgcagctggtggagtcgtgggggagcttggtacaggcccggggggtcctgagactctcctgtgcacgcctctggattctagtttaccngctatcgccagtcggccgtgggtcccgccgaggcctccgaggggaagggtcctggagtgggtcctcgaggttataggtggtacgtgctagtcgaccactatttcaccgacagtacctccgtaggaacgggtcccggttacaacccgtatttacccgagtacggtaaccaaattcccgaaagtacgttacccctagttaactccgtgaactaaagtacgaaaccacgacccgtagagaccggaccgaacggtaccgaaccggtccgtaaattacgttacnggtcgacgaaagtctaaacttacctataagacgatacttgacggtccctagtttacg

SEQ ID NO: 355550 - DNA, 602 bp, Homo sapiens
  misc_feature: GZ8MTXP02ID75H.52.71.G05.1.454.CMB.2.raw
  modified_base (248)..(248): a, c, t, g, unknown or other
  misc_feature (248)..(248): n is a, c, g, or t
  modified_base (280)..(280): a, c, t, g, unknown or other
  misc_feature (280)..(280): n is a, c, g, or t
  modified_base (295)..(295): a, c, t, g, unknown or other
  misc_feature (295)..(295): n is a, c, g, or t
tcagcgcagtacgacacgaccggtgctcgatttagtgtcgtcgcaagagagagggggggtgagggttgagaacctatgaacattctgtaggggccactgtcttctcctcggactccttgcttatggatcaggagtggattctcagactgtggtgacccaggagccatcgttctcagtgtccccctggagggacagtcacactcacttgtggcttgagctctggctcagtctctctaattctaccccanctgtaccagcacgccccagccaggcctccacncacgctcatctaacngcaacaattactcgctcttcgtcggggtccctgatcgtcttctcgtcggtctccatccgttaggacaaagctcgacccctaaccagtccgaccgggggcccaggacctagactaggataggaaacttctagtacttagtacgttgttacgttcttattaagtaggttagggtacgtggtacttaggtttcggtagttcggtacgggacgggaacgggtaaccgtagtccgtacgtacccggtcgttacggtaccgtacgacccgtaacgtccgtaccggcccccgttacgtacctaccgttcctccg

SEQ ID NO: 355551 - DNA, 515 bp, Homo sapiens
  misc_feature: GZ8MTXP02H4F1F.52.71.G05.1.454.CMB.2.raw
  modified_base (417)..(417): a, c, t, g, unknown or other
  misc_feature (417)..(417): n is a, c, g, or t
  modified_base (432)..(432): a, c, t, g, unknown or other
  misc_feature (432)..(432): n is a, c, g, or t
  modified_base (439)..(439): a, c, t, g, unknown or other
  misc_feature (439)..(439): n is a, c, g, or t
  modified_base (490)..(490): a, c, t, g, unknown or other
  misc_feature (490)..(490): n is a, c, g, or t
tcagcgcagtacgacacgaccggtgctcgatttagtgtcgtcgcaagagagaggggtgagggttgagaacctatgaacattctgtaggggccactgtcttctcctcggactccttgcttatggatcaggagtggattctcagactgtggtgacccaggagccatcgttctcagtgtccccctggagggacagtcacactcacttgtggcttgagctctggctcagtctctcctaattctaccccagctggtaccagcagaccccaggccaggcctccacgcacgctcatctacagcacaattactcgctcttctggggtcccctgactcgcttctctgctcatccttgggacaagctgaccctaacatcgacggggcccaggcagatgatgaatctgtattattactgtgtaccttntatagtgggtagtgntagttgngtggtcggcggaggacagctcgtaccgtcgtcggtacacgaccgaaggtcnccgccccgtacgcctacctcgtccg

SEQ ID NO: 355552 - DNA, 689 bp, Homo sapiens
  misc_feature: GZ8MTXP02JMCC6.52.71.G05.1.454.CMB.2.raw
  modified_base (375)..(375): a, c, t, g, unknown or other
  misc_feature (375)..(375): n is a, c, g, or t
  modified_base (436)..(436): a, c, t, g, unknown or other
  misc_feature (436)..(436): n is a, c, g, or t
tcagcgcagtacgacacgaccggtgctcgatttagtgtcgtcgcaagagagaggggtgagggttgagaacctatgaacattctgtaggggccactgtcttctcctcggactccttgcttatggatcaggagtggattctcagactgtggtgacccaggagccatcgttctcagtcgtcccctggagggacagtcacactcacttgtggcttgagtctcgtggctcgagtcctccttccttaaatttcctaccccagctcggtaaccagcacgaccccaggccacggcctcccacgcaccgctcatccgtaacacgacaactaattacgtccgtcctttccgtttcgtacggggttccctgactccgtctttcccncgtgtccctcctacgttcccgttaggggaacctaaacggtcctaccgtacccccttaaacncgtaccccgggaccgggggacccgacggtaacagacgagtagtagaacttctataactttacgttaacgtcgtcgttacctacttagttaggttggggttaacgtcggtattaagtttcgggtaagttcgggttcgggacgggtacggaacccgaagtccgtcggtacccgttcggtacggtccgaaccggccccggtaacggtccgtacccgtcccccgttcggtacccctaccgttacccgtttcccccgg

SEQ ID NO: 355553 - DNA, 415 bp, Homo sapiens
  misc_feature: GZ8MTXP01AD1LM.44.66.F11.1.454.CMB.2.raw
  modified_base (251)..(251): a, c, t, g, unknown or other
  misc_feature (251)..(251): n is a, c, g, or t
  modified_base (411)..(415): a, c, t, g, unknown or other
  misc_feature (411)..(415): n is a, c, g, or t
tcagacagtatatacacgaccggtgctcgatttagtcacgcgagagggccaccatcacctgcaagtccagccacaaccttggatacaggtccaacgttgagaattacttggtttggtatcaacagaaggcaggacagcctcctaggttcctcatttacgggacatccaggcgggcatccggggtccctgaccgattcagcgccagcggtctgggacagacttcgcactcaccatcaacggcctgcagggtnaagatcttgcaacttattactgtcagcagtatttgaaaggcccctcactttcggcggggggaccagggtggaactcagacgaactgtggctgcaccatctcgtcttcatcttcccgccatctgatatatactgtctgagcgggctggcaaggcgcatagnnnnn

SEQ ID NO: 355554 - DNA, 466 bp, Homo sapiens
  misc_feature: GZ8MTXP01BI6ST.44.66.F11.1.454.CMB.2.raw
  modified_base (457)..(466): a, c, t, g, unknown or other
  misc_feature (457)..(466): n is a, c, g, or t
tcagacagtatatacacgaccggtgctcgatttagtcacgcgagagggccaccatcacctgcaagtccagccacaaccttggatacaggtccaacgttgagaattacttggtttggtatcaacagaaggcaggacagcctcctaggttcctcatttacgggacatccaggcgggcagtcccggggtccctgaccgattcagcgccaggcgggtctgggacagacttcgcactcaccatcaacggcctgcgaggggtagaagatcttagctaaacttattactgtcagactagttatttaggaaaccgtcccctacgtacgtttcgggacgggggacgagggtcggaactcgagacgtagtgtgctgcactactcgtcgttctcactcccttccccgctactctcgtaattactacttctgtctggacggtcggcgtcggacgagggtcacgataggnnnnnnnnnn

SEQ ID NO: 355555 - DNA, 561 bp, Homo sapiens
  misc_feature: GZ8MTXP01DIW15.45.78.H01.1.454.CMB.2.raw
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (406)..(406): a, c, t, g, unknown or other
  misc_feature (406)..(406): n is a, c, g, or t
  modified_base (464)..(464): a, c, t, g, unknown or other
  misc_feature (464)..(464): n is a, c, g, or t
tcagacgcgatcgacacgaccggtgctcgatttagtgtgagtagtttgggtttgggtgaagaagcctgggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagngngaggntctagacgacacggccgtgtatactgtgcgagaggcaggattacgattttggagtggttattcggaacggtatggacgtctggggccaaggggaccacgggtcaccgtctcctcacgcnccaccgacggaccgacgtcgtccttccccgtcgccacccgtccctccaacgacgaccnccgtccgtcgggcgacgacgccggcccgtcggcgtcgccgtcggttcgaacggtacttacgttccttcgtaacgtcgtcgtcgtcgcggtcggcgtg

SEQ ID NO: 355556 - DNA, 474 bp, Homo sapiens
  misc_feature: GZ8MTXP01BHQ7M.45.78.H01.1.454.CMB.2.raw
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (381)..(383): a, c, t, g, unknown or other
  misc_feature (381)..(383): n is a, c, g, or t
  modified_base (385)..(385): a, c, t, g, unknown or other
  misc_feature (385)..(385): n is a, c, g, or t
  modified_base (393)..(394): a, c, t, g, unknown or other
  misc_feature (393)..(394): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (416)..(416): a, c, t, g, unknown or other
  misc_feature (416)..(416): n is a, c, g, or t
  modified_base (418)..(418): a, c, t, g, unknown or other
  misc_feature (418)..(418): n is a, c, g, or t
  modified_base (421)..(421): a, c, t, g, unknown or other
  misc_feature (421)..(421): n is a, c, g, or t
  modified_base (425)..(425): a, c, t, g, unknown or other
  misc_feature (425)..(425): n is a, c, g, or t
  modified_base (427)..(427): a, c, t, g, unknown or other
  misc_feature (427)..(427): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (457)..(458): a, c, t, g, unknown or other
  misc_feature (457)..(458): n is a, c, g, or t
  modified_base (464)..(464): a, c, t, g, unknown or other
  misc_feature (464)..(464): n is a, c, g, or t
  modified_base (466)..(466): a, c, t, g, unknown or other
  misc_feature (466)..(466): n is a, c, g, or t
  modified_base (473)..(473): a, c, t, g, unknown or other
  misc_feature (473)..(473): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggatggtatgaacgtatgatntgggcaagggcagtnacgntccnnncncacacgcnncgctccncgcncnctcanancncncgnggcncngcgccgngcngcngcgagacttcttcttcnncgcgcngngcggcgng

SEQ ID NO: 355557 - DNA, 606 bp, Homo sapiens
  misc_feature: GZ8MTXP01EMVZ5.45.78.H01.1.454.CMB.2.raw
  modified_base (243)..(243): a, c, t, g, unknown or other
  misc_feature (243)..(243): n is a, c, g, or t
  modified_base (247)..(248): a, c, t, g, unknown or other
  misc_feature (247)..(248): n is a, c, g, or t
  modified_base (252)..(252): a, c, t, g, unknown or other
  misc_feature (252)..(252): n is a, c, g, or t
  modified_base (255)..(255): a, c, t, g, unknown or other
  misc_feature (255)..(255): n is a, c, g, or t
  modified_base (261)..(261): a, c, t, g, unknown or other
  misc_feature (261)..(261): n is a, c, g, or t
  modified_base (267)..(267): a, c, t, g, unknown or other
  misc_feature (267)..(267): n is a, c, g, or t
  modified_base (486)..(486): a, c, t, g, unknown or other
  misc_feature (486)..(486): n is a, c, g, or t
  modified_base (548)..(548): a, c, t, g, unknown or other
  misc_feature (548)..(548): n is a, c, g, or t
  modified_base (579)..(579): a, c, t, g, unknown or other
  misc_feature (579)..(579): n is a, c, g, or t
tcagacgcgatcgacacgaccggtgctcgatttagtgtgagtagtttgggtttgggtgaagaagcctgggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatcgacgagacncgcnncacncancgccangagacncagcgcgagcgagagctgtacgacgacgacggtcgtagttacttacgtgtcgagaggagacgaagtaacgtagtttagtttaggtaggttaggtttagtccgggtaaagttagtcggtacgttcgggtcgggacggaacgggaccgtacgtaccgtccgtcttccacgcgtccctaccgaaaccggaccggaccctaggttcccgttccccttcccggngcccctacccgttccaacgaagccgacctcccgtggggcggacacgcgggtcccgtccgggngtctcgacgtcgacgacgtaccttcgttcgngtcgtcgtcgtagcgcggtcggcgtcg

SEQ ID NO: 355558 - DNA, 521 bp, Homo sapiens
  misc_feature: GZ8MTXP01DVZZU.45.78.H01.1.454.CMB.2.raw
  modified_base (226)..(226): a, c, t, g, unknown or other
  misc_feature (226)..(226): n is a, c, g, or t
  modified_base (463)..(463): a, c, t, g, unknown or other
  misc_feature (463)..(463): n is a, c, g, or t
  modified_base (469)..(469): a, c, t, g, unknown or other
  misc_feature (469)..(469): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
tcagacgcgatcgacacgaccggtgctcgatttagtgtgagtagtttgggtttggggagcatcacccagcaaccacatctgtcctctagagaactcccctgagagctccgttcctcaccatggactggacctggaggatcctcttcttggtggcagcagccacaggacgcccactcccaggtgcagctggtgcagtcgtgggctgaggtgaagagccgtgggcctnagtgaggtctctgcaaggtcttctggatacaccttcaccggctactatatacacgtgggtgcgacacggcccctggacgaagggcttggagtggagtgggatggatacaaaccctaacaagtggtggacaacgaaaaacttatcgacaacgtaagtaagtttcgaggggcagggtcacagtcgacgagggacacgtcactcagcaacacgcctacgagtggagctggagcgagtcgngaagcncgagaacgcgacggcttagtactgngngngngagngagtagttagtgttgtg

SEQ ID NO: 355559 - DNA, 558 bp, Homo sapiens
  misc_feature: GZ8MTXP01CUPLH.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgaggatctgacgacacggccgtgtattactgtgcgagaggcaggattacgattttggagtggtatcggaacggtatggacgtctggggcaaggggaccacgggtcaccgtctcctcagcctccaccaacggcccgactccggtccttcccctccggccacccgtccctcccaacgaacgccacctccgtcgggccgacgacgcggcccgtcgggcgtcgccgtcggttcgacggacttacgttccttcgaactcgcgtcgtgcgtcgggcggtg

SEQ ID NO: 355560 - DNA, 496 bp, Homo sapiens
  misc_feature: GZ8MTXP01ASFE5.45.78.H01.1.454.CMB.2.raw
  modified_base (266)..(266): a, c, t, g, unknown or other
  misc_feature (266)..(266): n is a, c, g, or t
  modified_base (345)..(345): a, c, t, g, unknown or other
  misc_feature (345)..(345): n is a, c, g, or t
tcagacgcgatcgacacgaccggtgctcgatttagtgtgagtagtttgggtttggggagtcagacccagtcaggacacagcatggacatgagggtcccgctcagctcctggggctcctgctgctctggctcccaggtgccaaatgtgacatccagatgacccagtctccttccaccctgtctgcatctgtaggagacagagtcaccatcacttgccgggcagtcagagtatagtaactggtgctggtatcagcagaacagggaaanccctaagctctgctctataaggcatctagtttagaaagtgggtccatcaaggttcagccggcagtggatcgtagggacngaattcactctcaccatcagcagcctgcagcctgatgatttgctaacttattactgacaacagtatgatagttattcgacgttcggccaagggaaccaagggttggaaattcgaaacgaacttgttggctgcaaccatcttgtcttctaac

SEQ ID NO: 355561 - DNA, 526 bp, Homo sapiens
  misc_feature: GZ8MTXP01A1ALV.45.78.H01.1.454.CMB.2.raw
  modified_base (508)..(508): a, c, t, g, unknown or other
  misc_feature (508)..(508): n is a, c, g, or t
  modified_base (517)..(517): a, c, t, g, unknown or other
  misc_feature (517)..(517): n is a, c, g, or t
  modified_base (519)..(519): a, c, t, g, unknown or other
  misc_feature (519)..(519): n is a, c, g, or t
  modified_base (525)..(525): a, c, t, g, unknown or other
  misc_feature (525)..(525): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaatacgattttggagtggttatcggaacgtatggacgtctggggccaagggccacgggtcaccgtctcctcacgcctccaccaacgggcccatccggtcttccccctggccacccgtcctccaacgacgcacctcgtgggggcacagcggccctgggctgctggttccaggcacgttcttcgntcgcgtcgngngcgcgng

SEQ ID NO: 355562 - DNA, 574 bp, Homo sapiens
  misc_feature: GZ8MTXP01AVT8R.45.78.H01.1.454.CMB.2.raw
  modified_base (271)..(271): a, c, t, g, unknown or other
  misc_feature (271)..(271): n is a, c, g, or t
  modified_base (316)..(316): a, c, t, g, unknown or other
  misc_feature (316)..(316): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (426)..(426): a, c, t, g, unknown or other
  misc_feature (426)..(426): n is a, c, g, or t
  modified_base (481)..(481): a, c, t, g, unknown or other
  misc_feature (481)..(481): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcgaggcgtgaaggactctagacggacacggcctgtatacngtgcgagaggcaggaattacggatttttggagttggttaacttcgggaaacggttatgggacgtcgtagggggcccaaaggggccacgggtcaccgtctcccncncgccnccacgacggccgacgtccgtccgtcccgtcgccacccgtccctaccacgacgccnccgtcgcgggcgcgacgccggccgcggcgtcgccgtcggttcgtacgtacgttaccgttccgttcgtcgtcgtcgtcgtcgcggtcggcgtcg

SEQ ID NO: 355563 - DNA, 571 bp, Homo sapiens
  misc_feature: GZ8MTXP01CV9G5.45.78.H01.1.454.CMB.2.raw
  modified_base (356)..(356): a, c, t, g, unknown or other
  misc_feature (356)..(356): n is a, c, g, or t
  modified_base (399)..(399): a, c, t, g, unknown or other
  misc_feature (399)..(399): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtattagtaactggttggcctggtatcagcagaaaccagggaaagccctaaagctctgctctataaggcatctagtttagaaagtgggggtccatcaaggttcagccggcagtggatcgtagggacngaattcaactctcaccatcagcagctgcagcctgatgtatttntactaacttaatttaacgttactaccaaacctaaggtaattagtaattaagtttaatttacgtacgttacggtaccgaaacgggaaaccgaaacgggttagggaaagttaacgaaaacgtaaacgttaagttggaccgttggacaaccaactcgttacgttcgttcttaacc

SEQ ID NO: 355564 - DNA, 549 bp, Homo sapiens
  misc_feature: GZ8MTXP01AW5QZ.45.78.H01.1.454.CMB.2.raw
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggccgagatctgacgacacggccgtgtattactgtgcgagaggcaggaattacgatttttggagtggttattcggacggtaatgggaacgtcgtgggggccaaggggaccacgggtcacccgtctcctcacgcctccaccaacgggcccatccggtcttccccctggcaccctccgtccaagacgccacctctcgggggcacgacgccggccctggggctgcccttggtccaggcctattccgttcgatcgcgtctgagcggcttggaacg

SEQ ID NO: 355565 - DNA, 624 bp, Homo sapiens
  misc_feature: GZ8MTXP01DON9F.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgaggatctagacgacacggccgtgtattactgtgcgagaggcaggaattacgtattttggagtggttatcggaacgtatggacgtcgtggggccaaggggaccacgggtcaccgtctcctcagccctccaccaacgggcccatccggtccttccccctcggccaccccgtccctacccgaaacgacgccacccgttcgtcggggggaccaccgaggcccgggtccccgtcgggggcccttcggccccgttggggttccgaaacggggtacccttaacccgtttcccttccggaacgttcccggccgtttcccggtacggacgggtccggggccggtcggg

SEQ ID NO: 355566 - DNA, 558 bp, Homo sapiens
  misc_feature: GZ8MTXP01C0VRU.45.78.H01.1.454.CMB.2.raw
  modified_base (287)..(287): a, c, t, g, unknown or other
  misc_feature (287)..(287): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagntctgacgacacggccgtgtattactgtgcgagaggcaggattacgattttggagtgttatcggaacgtatggacgtgtggggccaaaggggccacgggtcaccgtctctcacgcctcgaccaacgggcccagtccggtcctcccccgtcggccaccccgtcctcccaagacgccaccgtcgcgggggcacgtacgccggccctgggctcgccgttcggcgaacggacttaccgttccttcggaattccgcgttccgtcggcgtcggcgtcg

SEQ ID NO: 355567 - DNA, 656 bp, Homo sapiens
  misc_feature: GZ8MTXP01ETE0U.45.78.H01.1.454.CMB.2.raw
  modified_base (484)..(484): a, c, t, g, unknown or other
  misc_feature (484)..(484): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatggagctgagcgaggctgagatctagacgacacggctgtatactgtgcgagagcaggtaatacgtagttttggagttggttatcggaacggttatgggacgtcgggtggggaccgtaaaggggacccgtacgggtccacccggttctacccgtacgacggccccttacccgaaacccgaacggggtcccctaacgttcccggtcccctttccccccgnggacccctaacccccgttccctacccgaaacggaccgtcccaacccgttcgggcgggggaccaaccgtcgggccccggtcccgttggggccttcggacccgttcgggttaccgaaacgggtcccttaccgttccgaccgtaacgtcgcgttcgaggcggtcggcgtaacggg

SEQ ID NO: 355568 - DNA, 565 bp, Homo sapiens
  misc_feature: GZ8MTXP01ELZSC.45.78.H01.1.454.CMB.2.raw
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggcgtgagatctgacgacacggccgtgtattactgtgcgagaggcaggattacgattttggagtgtattcggaacgtatggacgtctggggccaaaggggaccacgggtcaccgtctctcagcctccaccaaacgggcccatcggtccttcccctcggccacccgtcctcccaagacgcacctctgggggcacacgcggccccggcgggcgtcgccgtcggttacgaacggtaccttaccgttccgttacgtaacgtccgtccgtcgtcgacggtcgggcggtcgg

SEQ ID NO: 355569 - DNA, 620 bp, Homo sapiens
  misc_feature: GZ8MTXP01DF9IW.45.78.H01.1.454.CMB.2.raw
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacactcacttgaattggttcaacagaggccaggccaatctaccaaggccgacctaaatttataaggtttctaaccgggactcgtggggtcccagacagatcagcgcaggtggtcaggcaactgaatttcaactactagaaaattaggagggtggagctggagatgttggtagtttattctgctatgacaaaggttacacgtacgtggacccgttaactaccgttttgggacccgtaagggggacccaaaggtccgttaagggaaaacttaacgaaaacggttaaacgttggttacgggtacttacggaccaccgttaacgttccttacgggttccttttaccgaacgtttccctttaacccccggccttaaccg

SEQ ID NO: 355570 - DNA, 583 bp, Homo sapiens
  misc_feature: GZ8MTXP01CUZUQ.45.78.H01.1.454.CMB.2.raw
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (289)..(289): a, c, t, g, unknown or other
  misc_feature (289)..(289): n is a, c, g, or t
  modified_base (312)..(312): a, c, t, g, unknown or other
  misc_feature (312)..(312): n is a, c, g, or t
  modified_base (322)..(322): a, c, t, g, unknown or other
  misc_feature (322)..(322): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagaagtttcagggcagggtcacatgaccaggacacgtccatcagcacagcctacatggagctgagcgagcgngagntcngacggacacggcgtgtattacgngtgcgagagnaagtatacgtacgtttggagttgtacgtcggaagtagtggtacgtcggtcgggacgaacgggacctacgtccaccgtctcctaccgacgccgtacccgaccgaaccggaccgacgtccgtcccgtccccgtccgtcctacccgtccctaccgaacgacgccgaccgtccggcgggacgaccgcggccggcccgtcggtcgtcgttccgtcgttacgaacgtacgttaccgttccttcgtctcgtcgtcgcgcggcggcgtg

SEQ ID NO: 355571 - DNA, 548 bp, Homo sapiens
  misc_feature: GZ8MTXP01AYPJY.45.78.H01.1.454.CMB.2.raw
  modified_base (268)..(268): a, c, t, g, unknown or other
  misc_feature (268)..(268): n is a, c, g, or t
tcagacgcgatcgacacgaccggtgctcgatttagtgtgagtagtttgggtttggggtcagacccagtcaggacacagcatggacatgagggtcccgctcagctcctggggctcctgctgctctggctcccaggtgccaaatgtgacatccagatgacccagtctccttccaccctgtctgcatctgtaggagacagagtcaccatcacttgccggccagtcagagtattagtaactggttgctggtatcagcagaaaccagggaaanccctaagctcctgctctataaggcatctagtttagaaagtggggtcccatcagtcagcggcagtgatctggaacagaattcactctcaccatcagcagcctgcagcctgatgattttgactaacttattactggacctaaactagtatagtaatagtttattacggacgtttcgggaccgtaaacggggaaccgtaaagggtaggaaaatacgaaaacggtaacgtggttacgggcttaggcctacaacttccctaggttccttccgttaactttccccg

SEQ ID NO: 355572 - DNA, 574 bp, Homo sapiens
  misc_feature: GZ8MTXP01DQBP9.45.78.H01.1.454.CMB.2.raw
  modified_base (465)..(465): a, c, t, g, unknown or other
  misc_feature (465)..(465): n is a, c, g, or t
  modified_base (468)..(468): a, c, t, g, unknown or other
  misc_feature (468)..(468): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctagacgacacggccgtgtattactgtgcgagaggcaggattacgattttggagtggttattcggaacggttatggacgtcgtgggggccaaggggacacggtcaccgtctcctcacgcctaccaccgaacgggcccagtccggtccttcccctggccaccctcctccaacgaccnccnccgtcgcggggcacgcggccggccgtgggcgtcggccgtacggttacgaacggtaccttaccgttccgttacgaacgtccggcgttcgcggcgggtcgggcgtggg

SEQ ID NO: 355573 - DNA, 534 bp, Homo sapiens
  misc_feature: GZ8MTXP01EWIOR.45.78.H01.1.454.CMB.2.raw
  modified_base (524)..(524): a, c, t, g, unknown or other
  misc_feature (524)..(524): n is a, c, g, or t
  modified_base (533)..(533): a, c, t, g, unknown or other
  misc_feature (533)..(533): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggtattcggaacgtatggacgtctggggccaaggggaccacggtcaccgtctcctcagcctcaccaacgggcccatcggtcctcccctgccacccgtcctccaagacgcacctctgggggcacgagccgccctggggctgccctggttcgaagggcttacgttccttcgaatccgcgttcgngcgcggcgng

SEQ ID NO: 355574 - DNA, 659 bp, Homo sapiens
  misc_feature: GZ8MTXP01C4F3I.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtatactgtgcgagaggcaggaattacgtatttttggagttggttattcggaacggttatggacgtcgtaggggccaaggggaccacgggtcaccgtctcctcacgcctacccaccgaacggggccccaacgtcccggtccttcccccgtcgggccccaaccccgttcccctacccgaaacgacgccaacccgtccgtcggggggccaccgacggcccgggccccgttcgggggcccttcgggccccgttcggggttaccgtaaaacggggtacctttaacccgtttccccgttaccgggtaaccgtttccggcccggtttccgttgggacgggtcccgggggccgttccggggg

SEQ ID NO: 355575 - DNA, 545 bp, Homo sapiens
  misc_feature: GZ8MTXP01C1G0K.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggctgagtggatgggatggatcaaccctaacaatggtggacaacaaaaactatgacacagtaagtttcagggcagggtcacatacgacgaggacacgtccatcagcacacgcctaacgagtggacgcgtaggacgcggaggtcgaggaagtacgtcgtagaacgacgacgggtccgttagttaacgttacgttggttgcggaaggaggcgaaggtagttacgttaagttttgggtaagg

SEQ ID NO: 355576 - DNA, 600 bp, Homo sapiens
  misc_feature: GZ8MTXP01B4WKP.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcagaatacgattttggagtggtattcggaacggttatggacgtcgtggggccaaggggaccacgggtcacccgtctccgtcagcctcaccaagggcccatcggtcctcccctggccacccgtcctccaagcgccaccctcgtcgggggaccacgcggccggccccgtgggggcccttcggcccgtcggttccgaaacggggtccttaaccgtttccccgttcggtaacgttcccggccggtttcccgggtacgggaccgggtccggggttcggtcggg

SEQ ID NO: 355577 - DNA, 515 bp, Homo sapiens
  misc_feature: GZ8MTXP01DV2CJ.45.78.H01.1.454.CMB.2.raw
  modified_base (287)..(287): a, c, t, g, unknown or other
  misc_feature (287)..(287): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (475)..(475): a, c, t, g, unknown or other
  misc_feature (475)..(475): n is a, c, g, or t
  modified_base (491)..(491): a, c, t, g, unknown or other
  misc_feature (491)..(491): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtncgacacggcccctggacaaggcttgagtggagtgggatggatcaaaccctaacaagtggtagtacaacaaaaactatgcaacagtaagttcgagggcagggtcacatcgacgaggacacgtccatcagcacagcctacgagtggagctgagcgaggctgagntcngaacgacgcggcgttgtacttcngttgcggaagcggaanaggtaattagtaagttttggaagg

SEQ ID NO: 355578 - DNA, 693 bp, Homo sapiens
  misc_feature: GZ8MTXP01CTCS4.45.78.H01.1.454.CMB.2.raw
  modified_base (247)..(247): a, c, t, g, unknown or other
  misc_feature (247)..(247): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtccaggatccagtggggatgttgtgatgactcagtctccactctccctgcccgtcacccttggacagccgcctcatctcctgcaggtctagtcaaagcctctatacgagggataggaaacnctcacttgaattggttacaacagacggaccaggaccaatcctaccgaaaggcgtaccttaaatttagtaaacggtttcctaaaccggggtactcgtcgggggtaccccagacagattcgagcggcaggtggtcaggcaactgaatttcactaacgtagaaaagttggtagggtggagtcgtaggaggtagttggttaggtagtttttatttcgtgtcagttgacgtaaaggtacacgtaacggttcggacccgttaacgtaaccgttttcgggacccgtaaacggggggtaaccctaaagggtaccgttaacgggaaaacttaaccgaaaaaccgggttaaaccgtttgggttacggtacccgttacggacccgttaaccgaacgtttccgttacggtttcctttaccgtaccgtttaccctttcccccggttaacccgttaaccg

SEQ ID NO: 355579 - DNA, 512 bp, Homo sapiens
  misc_feature: GZ8MTXP01BPH0O.45.78.H01.1.454.CMB.2.raw
  modified_base (351)..(351): a, c, t, g, unknown or other
  misc_feature (351)..(351): n is a, c, g, or t
  modified_base (417)..(417): a, c, t, g, unknown or other
  misc_feature (417)..(417): n is a, c, g, or t
tcagacgcgatcgacacgaccggtgctcgatttagtgtgagtagtttgggtttggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtattagtaactggtggctggtatcagcagaaaccagggaaagcccctaaagcctacctgctctataaggcatctagtttagaaagtgggtccatcaggtcagccgcagtggatcgtgggacngaattcactctcacatcagcagcctgcagcctgatgatttgactaactttattactgtacccaaanaggtatgattagttattcgtacggttcgaccgaaagggaaccaaggttaggaaattcgaaacgacttgttggactgcaacatcttgtcttctaac

SEQ ID NO: 355580 - DNA, 545 bp, Homo sapiens
  misc_feature: GZ8MTXP01BL5AG.45.78.H01.1.454.CMB.2.raw
  modified_base (287)..(287): a, c, t, g, unknown or other
  misc_feature (287)..(287): n is a, c, g, or t
  modified_base (488)..(488): a, c, t, g, unknown or other
  misc_feature (488)..(488): n is a, c, g, or t
  modified_base (524)..(524): a, c, t, g, unknown or other
  misc_feature (524)..(524): n is a, c, g, or t
  modified_base (527)..(527): a, c, t, g, unknown or other
  misc_feature (527)..(527): n is a, c, g, or t
  modified_base (536)..(536): a, c, t, g, unknown or other
  misc_feature (536)..(536): n is a, c, g, or t
  modified_base (544)..(544): a, c, t, g, unknown or other
  misc_feature (544)..(544): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagctgagntctgacgacacggccgtgtattactgtgcgagaggacaggaattacgtagttttggagttggttattcggaacgttatggacgtgtggggccaagggccacggtcaccgtctcctcgacgccctccgacccgaacgggcccacgtccggtccttcccccgtggccccacccgtcctaccaagacgccaccgtcgcggggcncgagccgccctgggctgcctgcgaaggcttacttcncgntcgcgtcgngcgcgcgng

SEQ ID NO: 355581 - DNA, 570 bp, Homo sapiens
  misc_feature: GZ8MTXP01DRP4C.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgctacaggcccctggacaagggcttgagtggatgggatggatcaaccctaacaatggtggcacaaactatgcacagaagtttcagggcagggtcaccatgaccagggacacgtccatcagcacagcctacatggagctgagcgagctgagatctagacgacacggccgtgtattactgtgcgagagcaggattacgtattttggagtgttatcggaacgtatggactcgtggggcaggggaccacgggtcaccgtctcctcacgcctccaccgaacgggcccagtccggtccttcccccgtggcccgcccgttcgccgttcccgagggacgccgaccgtcggtcgggggcacgcggccggcccgtgggcttgcccgttggtcgaacgggaccttacttcccgttcggacttccggcgtcgttgaacggcgggcg

SEQ ID NO: 355582 - DNA, 594 bp, Homo sapiens
  misc_feature: GZ8MTXP01CY6SU.45.78.H01.1.454.CMB.2.raw
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagtttcagggcagggtcaccatgaccagggacacgtccatcagcacagcctacatggagctgagcgagctgagatctgacgacacggccgtgtattactgtgcgagaggcaggatacgtattttggagtgtatcggaacgtatggacgtcgtggggccaagggccacggtcaccgtctcctcacgcctaccaccgaacgggcccagtccggtcctccccgtggcccacccgtcctaccaacgacgccacccgttcgcgggggccaacgcggccggccccgtggggcctcggacccgttgggaccgaaacgggtccttaacctttcccgttccggaacgttccggccgtttccgtaagggaccgggtccggggcccgggtcggg

SEQ ID NO: 355583 - DNA, 569 bp, Homo sapiens
  misc_feature: GZ8MTXP01A841Y.45.78.H01.1.454.CMB.2.raw
  modified_base (485)..(485): a, c, t, g, unknown or other
  misc_feature (485)..(485): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcacatgaccaggacacgtcatcagcacagcctacatggagctgagcgaggctgagatctgacgacacggcgtgtattactgtgcgagagcaggtaattacgtattttggagtggttatcggaacgtatggagtcgtggggacaaggggaccacggtcaccgtctcctcgacgccctccaaccgaacgggccctactccggtcccttcccccgtggcccacccgttccaccgaaacgcgccaccgtcgcggggaccncgacggccgcccgtggcctgccgtggttcgaaacggtcttaccgttccgcgtaagtcgtccgttgcggacggcgggttccgtgg

SEQ ID NO: 355584 - DNA, 607 bp, Homo sapiens
  misc_feature: GZ8MTXP01ELF4C.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtattactgtgcgagaggcaggattacgtattttggagttggttatcggtaacggttatgggacgtcgtggggaccgaagggaccacgggtcaccgtctccgtcacgccctcccaaccgaacggggcccctaacgtccggttcccttcccccgtcgggccccaccccggtccctacccgaaacgacgcctaccctcggtcgggggaccacgacggccggcccgtgggcctgcccgtggttacgaacgggtaccttaccgttccttcgtaactccgcgtccgtggacggtcgggcgtaacggg

SEQ ID NO: 355585 - DNA, 566 bp, Homo sapiens
  misc_feature: GZ8MTXP01C92LU.45.78.H01.1.454.CMB.2.raw
  modified_base (537)..(537): a, c, t, g, unknown or other
  misc_feature (537)..(537): n is a, c, g, or t
  modified_base (541)..(541): a, c, t, g, unknown or other
  misc_feature (541)..(541): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggattacgattttggagtggttattcggaacggtatggacgtcgtggggccaagggaccacgggtcacccgtctccgtcacgcctccgaaccgaacggggcccacgtccggtccttcccccgtcgggccctaccccgtccctcccaaacgacgccacccgtcgtgggggccacgagccggcctgggctgcctggttcgaacggcttacgttccncgtntcgcgtccgtgacgtcgggctcggg

SEQ ID NO: 355586 - DNA, 584 bp, Homo sapiens
  misc_feature: GZ8MTXP01CR07Q.45.78.H01.1.454.CMB.2.raw
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (311)..(311): a, c, t, g, unknown or other
  misc_feature (311)..(311): n is a, c, g, or t
  modified_base (383)..(383): a, c, t, g, unknown or other
  misc_feature (383)..(383): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagngngaagntcngacgacacggctgtatacngtgcgagagcaggattacgtattttggagttggttatcggaaggtatggacgtcgtggggacccagggaccncgggtacaccgtctcctcgacgcctccgaccaacgggcccacgtccggtccttcccccgtcggccaccccgtccctaccaaacgcgccaccgtcgcggggaccacgtacgccggtcccggcggccgtcggccgtcggttaccgtaacggtaccttcgttcccgttcgtaacgtccgtcgtcgtcggttacggtcggcgtcg

SEQ ID NO: 355587 - DNA, 510 bp, Homo sapiens
  misc_feature: GZ8MTXP01D3STE.45.78.H01.1.454.CMB.2.raw
  modified_base (226)..(226): a, c, t, g, unknown or other
  misc_feature (226)..(226): n is a, c, g, or t
  modified_base (425)..(425): a, c, t, g, unknown or other
  misc_feature (425)..(425): n is a, c, g, or t
  modified_base (444)..(444): a, c, t, g, unknown or other
  misc_feature (444)..(444): n is a, c, g, or t
  modified_base (484)..(484): a, c, t, g, unknown or other
  misc_feature (484)..(484): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctnagtgaaggtctcctgcaaggcttctggatacaccttcaccggctactatatacactgggtgcgacaggcccctggacaagggcttgagtggatgggatggatcaacctaacaatggtggcaacaaaaactatgcaacagaagtttcgaggggcagggtcacatgacagggacacgtcatcagcacagcctacatggaanctgagcgaggctgagatcngaacgacgacggccgttgtattacgttgttgcgaagaggntaaggattagtaagttttggtaaggg

SEQ ID NO: 355588 - DNA, 506 bp, Homo sapiens
  misc_feature: GZ8MTXP01BNLQQ.45.78.H01.1.454.CMB.2.raw
  modified_base (272)..(272): a, c, t, g, unknown or other
  misc_feature (272)..(272): n is a, c, g, or t
  modified_base (409)..(409): a, c, t, g, unknown or other
  misc_feature (409)..(409): n is a, c, g, or t
  modified_base (485)..(485): a, c, t, g, unknown or other
  misc_feature (485)..(485): n is a, c, g, or t
  modified_base (500)..(500): a, c, t, g, unknown or other
  misc_feature (500)..(500): n is a, c, g, or t
tcagacgcgatcgacacgaccggtgctcgatttagtgtgagtagtttgggtttgggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttgctggtatcagcagaaaccagggaaacncccctaagctcctgctctataggcatctagttagaagtgggtccatcaagtcagcgcagtggatcgtggaacagaatcactctcaccatcagcagcctgcagcctgatgtatttgctaattattactggacctaaanagtatagtatagttattcgacgttcggaccgaagggaccaaagggtggaaatacgaaacgaactgttaggcttgcncaatctcgttcttcngttccc

SEQ ID NO: 355589 - DNA, 594 bp, Homo sapiens
  misc_feature: GZ8MTXP01AZ2SL.45.78.H01.1.454.CMB.2.raw
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgtatttttggagtggttattcggaacggtatggacgtcgtggggccaagggaccacgggtcaccggtctcctcacgcctccaccgaacgggcccagtccggtccttcccccgtgcccacccgtccctccaacgacgccaccgtcgcgggggcacgacgccggcccgtcggggcttcggccgtcgggttaccgaaacgggtccttaaccgttcccttccggaacgttccgccgtttcccggtcgggacgggtccgggcgtcggg

SEQ ID NO: 355590 - DNA, 554 bp, Homo sapiens
  misc_feature: GZ8MTXP01BPO29.45.78.H01.1.454.CMB.2.raw
  modified_base (425)..(425): a, c, t, g, unknown or other
  misc_feature (425)..(425): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtatactgtgcgagaggcaggaattacgtattttggagtggttatcggaacggtatgggacgtcgtggggaccaagggaccacggtcaccgtctcctcacgcctccaccaacgggcctacncgtccgtccctcccgtcgccctccctcctaccaacgcacctccgtcgggcgggcacgcggcccgccggcggcttcgcgttcgtacgagttaccttccttccgtgactccgcgtcgttgcggttcggcgg

SEQ ID NO: 355591 - DNA, 509 bp, Homo sapiens
  misc_feature: GZ8MTXP01EBAXK.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaggtctcctgcaaggcttctggatacaccttcaccggctactatatacactgggtgcgacaggcccctggacaaggcttgagtggatgggatggatcaacctaacatggtggcacaaaactatgacacaagaagtttcagggtcagggtcaccatgacaggacacgtcatcagcacagcctacgatggagcgtagagcgaggacgtgagatcgtggaacgcgacggccgttagtattacgttgttgagaagaggcaggtattagtaagttttggtaagg

SEQ ID NO: 355592 - DNA, 556 bp, Homo sapiens
  misc_feature: GZ8MTXP01DBSYQ.45.78.H01.1.454.CMB.2.raw
  modified_base (290)..(290): a, c, t, g, unknown or other
  misc_feature (290)..(290): n is a, c, g, or t
  modified_base (546)..(546): a, c, t, g, unknown or other
  misc_feature (546)..(546): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatcngacgacacggccgtgtattactgtgcgagaggcaggattacgattttggatggtattcggaacgttatggacgtcgtggggccaaggggaccacgggtcaccgtctcctcacgcctccaccaacggggcccacgtccggtccttcccctggcccacccgtccctcccaacgacgccaccctcgtcgggggcacgtcggccggcccgtgggcctcgccgttcggcgaacggcttacgttccttcgaatcgcgttcgngcgcggcgtg

SEQ ID NO: 355593 - DNA, 560 bp, Homo sapiens
  misc_feature: GZ8MTXP01BMC8Y.45.78.H01.1.454.CMB.2.raw
  modified_base (480)..(480): a, c, t, g, unknown or other
  misc_feature (480)..(480): n is a, c, g, or t
  modified_base (546)..(546): a, c, t, g, unknown or other
  misc_feature (546)..(546): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattacgtgtgcgagaggcaggaattacgtattttggagtggttattcggaacggtatggacgtcgtggggccaagggccacggtcaccgtctcctcgacgcctccaccacgggcccacgtccggtccttcccctcgcccaccctccctccaagacgccaccgtcgtcggggccncgcgccggcccgtggggctcgcctcggttcgaacggtcttaccgttccttcgctccgcgttccggnggcggtcggcgtgg

SEQ ID NO: 355594 - DNA, 569 bp, Homo sapiens
  misc_feature: GZ8MTXP01D8W8X.45.78.H01.1.454.CMB.2.raw
  modified_base (284)..(284): a, c, t, g, unknown or other
  misc_feature (284)..(284): n is a, c, g, or t
  modified_base (403)..(403): a, c, t, g, unknown or other
  misc_feature (403)..(403): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacagtggagctgagcgagcngaggatcagacgacacggcgtgtattactgtgcgagagcaggtattacgtattttggagttggttatcggaacgtatggacgtcgtggggaccaaggggccacgggtcacccgtctccncacgccctaccaccgaacgggccctacgtccggttccctccccgtggccctaccccgtcctacaagacgccaccgtcgcggggccacgcgccggcccgtgggaactcggctgggttcaaaggtccttacttccgttacgcttcgcgttcgggcggcggtcgcggcg

SEQ ID NO: 355595 - DNA, 559 bp, Homo sapiens
  misc_feature: GZ8MTXP01EOCSY.45.78.H01.1.454.CMB.2.raw
  modified_base (409)..(409): a, c, t, g, unknown or other
  misc_feature (409)..(409): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaaactatgcacagaagtttcagggcagggtcaccatgaccagggacacgtccatcagcacagcctacatggagctgagcgaggcgtgagatctagacgacacggccgtgtatactgtgcgagaggcaggaattacgattttggagtgtattcggaacgtatggacgtcgtggggccaaggggaccacgggtcaccgtctcctcacgccnccaccgacggaccgacgtcgtcctccccgtcgccacccgtccctaccgaacgacgccgaccgtcgtcgggcgacgcgccggccgtcggcgtcgccgtcgttcgacgtacgttacgttccgttcgtctcgtcgtcgtcgcggtcggcgtcg

SEQ ID NO: 355596 - DNA, 536 bp, Homo sapiens
  misc_feature: GZ8MTXP01DZYB4.45.78.H01.1.454.CMB.2.raw
  modified_base (472)..(472): a, c, t, g, unknown or other
  misc_feature (472)..(472): n is a, c, g, or t
  modified_base (509)..(509): a, c, t, g, unknown or other
  misc_feature (509)..(509): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatggagctgagcaggctgagatctgacgacacggccgtgtattactgtgcgagaggcaggaattacgattttggagtggttattcggaacgtatgggacgtcgtggggccaagggaccacgggtcaccgtctcctcagcctccaccaagggcccatccggtcttccccctgcccacccgtcctccaagacgcacctcgtggggcacgngcggccctgggctgcctggttcaaggcttacgttccncgaatcgcgtcgtcgagcgggctcggg

SEQ ID NO: 355597 - DNA, 529 bp, Homo sapiens
  misc_feature: GZ8MTXP01CTZI5.45.78.H01.1.454.CMB.2.raw
  modified_base (375)..(375): a, c, t, g, unknown or other
  misc_feature (375)..(375): n is a, c, g, or t
  modified_base (493)..(493): a, c, t, g, unknown or other
  misc_feature (493)..(493): n is a, c, g, or t
  modified_base (498)..(498): a, c, t, g, unknown or other
  misc_feature (498)..(498): n is a, c, g, or t
  modified_base (525)..(525): a, c, t, g, unknown or other
  misc_feature (525)..(525): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctaggaccgaagggcttggagtgggagtgggatgggtaccaaaccctaacaagtggtaggcaacaaactaatgcaanagtaaagtttcgagggcagggtcaccatcgacgagggacacgtcatcagcacagacctaacgagtcggagcgtgagcgagcgtagagtactgcgaacgcgacggcgtagttattacgngttgngagaagagaagtattagttagtttggnggtg

SEQ ID NO: 355598 - DNA, 607 bp, Homo sapiens
  misc_feature: GZ8MTXP01D2I4O.45.78.H01.1.454.CMB.2.raw
  modified_base (587)..(587): a, c, t, g, unknown or other
  misc_feature (587)..(587): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagagcaggtaattacgtagttttggagttggttagttcggaacggttagtgggtacgtcgtacgggggaccgaaggggaccgacgggtccaccgtcctccgtcacgtccctaccgaacccgaacgggccctacgtccggtcccttccccgtcggccctaccccggtccctaccgaaacgcgccacccgtcggtcgggggaccacgcgccggcccgtgggctcgccgtcggacgaacggtccttaccgttccgttacgcgtccgcggttcncggacggtccgggcgtcggg

SEQ ID NO: 355599 - DNA, 595 bp, Homo sapiens
  misc_feature: GZ8MTXP01DSBSK.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagctgagatctgacgacacggcctgtatactgtgcgagaggcaggtattacgtatttttggagtcggttatcggtaacggtagtggacgtcgtggggccaaggggaccacggtcaccgtctcctcacgcctccaccgaacgggcccactccggttccttcccccgtcggcccaccccgttccctacccaaacgacgccacccgtcgtcgggggaccaccgtacgccggccccttggggccttcgcccgtgggttaccgaaacgggtcttaaccgttccgttcgaatccggcgttcggtcggacggtcgggcgtcgg

SEQ ID NO: 355600 - DNA, 606 bp, Homo sapiens
  misc_feature: GZ8MTXP01EE19M.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgtattttggagttggttattcggaacggttatgggacgtcgtgggggccaaggggaccacggtcaccgtctcctcacgcctccaacccgacgggcccagtccggtcccttcccctggcccacccgtccctacccgaacgacgccacccgtcgtcgggggaccaccgacggccggcccgtggggccttcggcccgtcgggttccgaaacgggtccttacccgttcccgttcggtaacgtccggtccgttctcgggacggtccggggcgtccgggg

SEQ ID NO: 355601 - DNA, 506 bp, Homo sapiens
  misc_feature: GZ8MTXP01BXYGL.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggccccctggacaagggcttgagtggatgggatggatcaacctaacaatggtggcacaaaactatgcacagaagtttcgagggcagggtcacatgacagggacacgtcatcagcacagcctacatggagcgtgagcgaggcgtgagatcgtgaacgacgacggccgttgtagtacttgttgcgaagaggcgaggtagttagtgttttggtaagg

SEQ ID NO: 355602 - DNA, 600 bp, Homo sapiens
  misc_feature: GZ8MTXP01ERO9J.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacgacggccgtgtattactgtgcgagaggcaggaattacgtagttttggagtggttatcggaacggtatgggacgtcgtggggaccaagggaccacgggtcacccggtctcctcacgccctccaaccgaacgggccccacgtccggtcccttcccccgtgcccacccctcctaccgaaacgcgccacccgtcggtcgggggccacgacggcccggtcccgtggggcctcggcccgtggttaccgaaacggtccttaccgtttcccgacgaacgttccgcgttccggtggacggtcgggttcgtcgg

SEQ ID NO: 355603 - DNA, 561 bp, Homo sapiens
  misc_feature: GZ8MTXP01BFQY9.45.78.H01.1.454.CMB.2.raw
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagngngaaggctcgtagacgacacggccgtgtattactgtgcgagaggcaggattagtattttggagtggttatcggaagtatggacgtcgtggggcaagggccacgggtcaccgtctccctcgacgccaccgaccgacgaccgacgtccgtccgtcccgtccgccacccgtcctaccgacgacgaccgccgtcgtcggcgcgcgccggccgcggtcgtcgttcgtcggttacgtacgtacttccgttccgttcgtcgtcgtcgtcgtcggcggtcggcgtg

SEQ ID NO: 355604 - DNA, 527 bp, Homo sapiens
  misc_feature: GZ8MTXP01COQS1.45.78.H01.1.454.CMB.2.raw
  modified_base (366)..(366): a, c, t, g, unknown or other
  misc_feature (366)..(366): n is a, c, g, or t
  modified_base (445)..(445): a, c, t, g, unknown or other
  misc_feature (445)..(445): n is a, c, g, or t
  modified_base (461)..(461): a, c, t, g, unknown or other
  misc_feature (461)..(461): n is a, c, g, or t
  modified_base (469)..(469): a, c, t, g, unknown or other
  misc_feature (469)..(469): n is a, c, g, or t
  modified_base (492)..(492): a, c, t, g, unknown or other
  misc_feature (492)..(492): n is a, c, g, or t
  modified_base (498)..(498): a, c, t, g, unknown or other
  misc_feature (498)..(498): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcagtgaaggtctcctgcaaggcttcgtggatacaccttcaccggctactatatacacgtgggtgcgacacggcccctggacaagggcttggagtggagtgggatggatcgaacctaacaagtggtgacaacaaaaactntgacaacgagtaagttcgagggtcagggtcacagtagacgaggacacgtccatcacgcaacgagacctacgagtggacncgtagacgcgagtcgngagactcnggaacgcacggcgttgtaatcgngttcgngaagagcgaggtattagtgtttggtaagg

SEQ ID NO: 355605 - DNA, 503 bp, Homo sapiens
  misc_feature: GZ8MTXP01E2J98.45.78.H01.1.454.CMB.2.raw
  modified_base (468)..(468): a, c, t, g, unknown or other
  misc_feature (468)..(468): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtgggatgggatggatcaaaccctaaccaatggtgcacaaaactatgcacagtaagtttcagggcagggtcacatgacagggacacgtcatcagcacagcctacgatggagctgagcgaggctgagatctgaacgacgacggccgttgtattacngttgcgaagagcgaggattacgtgttttggtaagg

SEQ ID NO: 355606 - DNA, 549 bp, Homo sapiens
  misc_feature: GZ8MTXP01DVETD.45.78.H01.1.454.CMB.2.raw
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
  modified_base (316)..(316): a, c, t, g, unknown or other
  misc_feature (316)..(316): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
  modified_base (440)..(440): a, c, t, g, unknown or other
  misc_feature (440)..(440): n is a, c, g, or t
  modified_base (459)..(459): a, c, t, g, unknown or other
  misc_feature (459)..(459): n is a, c, g, or t
tcagacgcgatcgacacgaccggtgctcgatttagtgtgagtagtttgggtttggggtgaagaagcctggggcctcagtgaaggtctcctgcaaggcttctggatataccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagngtcgagatctagacgacacggccgtntagttacngtgcgagagcaggattacgattttggagtgttatcggaacgtatggagtcgtggggccaagggccacgggtcaccgtcncctcacgccnccaccaacgggccactcggtcctcccctcgccccncccgtcctccacgacgccnccgtcgcgggacgacgcgccggccgtcggcgtcgcgtcgttacgtacgtacttacgttccttcgtcgtcgcgtcgtcgcggtcggcgtcg

SEQ ID NO: 355607 - DNA, 599 bp, Homo sapiens
  misc_feature: GZ8MTXP01C2LTU.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtatactgtgcgagaggcaggattacgtatttttggagttggttattcggaacgttagtggacgtcgtggggaccgaagggaccacgggtcaccgtctcctcacgcctccacgacgggcccactccggtcctccccctggcccacccgtcctacccgaacgacggccacccgtcgtcgggggccacgacgccggcccgtggggcctcggcccgtgggttaccgtaaacgggtccttaacccgtttcccgttacgaacgtccggtccgttccgtggacggttccggggcgtcgggg

SEQ ID NO: 355608 - DNA, 633 bp, Homo sapiens
  misc_feature: GZ8MTXP01AU6KI.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagagcaggatacgtattttggagtggttatcggaacgtatgggacgtcgtggggacctaagggccacggtcaccgtctcctcacgcctccaccgaacgggcccagtccgggtccttcccccgtggtcccaaccccttccctacccgaaacgaccggccacccgtccgtacgggggcccacgtacgggcccggccccgtcgggggcctcggcccgttcgggttaccgtaaacggggtaccctttaacccgttcccgttaccgggtaacttcccgggtccgtttcccgtaggacgggtcccgggggcgtaaccggggg

SEQ ID NO: 355609 - DNA, 564 bp, Homo sapiens
  misc_feature: GZ8MTXP01ENQYE.45.78.H01.1.454.CMB.2.raw
  modified_base (483)..(483): a, c, t, g, unknown or other
  misc_feature (483)..(483): n is a, c, g, or t
  modified_base (491)..(491): a, c, t, g, unknown or other
  misc_feature (491)..(491): n is a, c, g, or t
  modified_base (521)..(521): a, c, t, g, unknown or other
  misc_feature (521)..(521): n is a, c, g, or t
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagagccgtgggcctcgagtgaaggtctcctgcaaggtcttcgtggataccaccttcaccggctactatatacacgtgggtgcgacgacggccccgtggacgaagggtcttaggaggtgggagtgggatggactaccgaaaccctaaacgagtggtaggacaaactaaaaactatgacaacgagtaagtttcgaggggcacgggtacacgagtacgaccgaggacaccgtacatacagcacacgacctacgagtaggagtcgagacgcgaggcgngagctcgngaacgacgcggtcgttagtacgtagttggngacggaaggaggaagtaaggtagttacggttaagtttggtaag

SEQ ID NO: 355610 - DNA, 540 bp, Homo sapiens
  misc_feature: GZ8MTXP01BB15R.45.78.H01.1.454.CMB.2.raw
  modified_base (458)..(458): a, c, t, g, unknown or other
  misc_feature (458)..(458): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctggacaagggcttgagtggagtgggatggatcaaaccctaacaagtggtaggacaacaaaaactatgacaacgagtaagtttcgagggcagggtcacatcgacgagggacacgtccatcagcacagacctacgagtggagcgtgagcgagcgtagaganctagaacgacgacggtcgttgtacgttacgttggttggcgaaggacggcgtaagggtattacggtaagtttttgggtaaggg

SEQ ID NO: 355611 - DNA, 587 bp, Homo sapiens
  misc_feature: GZ8MTXP01ANBEV.45.78.H01.1.454.CMB.2.raw
  modified_base (456)..(456): a, c, t, g, unknown or other
  misc_feature (456)..(456): n is a, c, g, or t
  modified_base (585)..(585): a, c, t, g, unknown or other
  misc_feature (585)..(585): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcggagaggcaaggtaattacgatttttggagtggttatcgggaacgttatggacgtcgtggggccaagggccacgggtcaccgtctccctcacgcctccaaccgaacgggcccacgtccggtcccttcccccgtggacccnccccgtacctcccaagacgccacccgtcgcgggggcaccgcggccggcccgtggggcctcggccgtcggttacgaacggtaccttaccgtttccgcgaacgttccgcgttcgcggcggcgggttccggngg

SEQ ID NO: 355612 - DNA, 702 bp, Homo sapiens
  misc_feature: GZ8MTXP01C6QJH.45.78.H01.1.454.CMB.2.raw
  modified_base (275)..(275): a, c, t, g, unknown or other
  misc_feature (275)..(275): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatacaaccctaacaatggtggcaacaaactatgcaacagtaagtttcgagggcgagggtcaccatcgaaccgagggacacgtccatcagcacagcctanagtggagctaggagcgaggctaggacgtatacgtacgacgaccgacgggtccgttagttattacgtggtacgacggaggaggacgtaaggttaagttacgttagttttagggtagttaggttacgtcgggtaaacggttagtcgggtaccgtacggtcggggaccgaacgggacccgtacgggtccacccgttctccctacgaccgccctacccgaaccggaaccgggtccctacggttccggttccccttccccgacgcccctacccggttacccaccgaaagtccaccgtacccgtcgggtacggggaccaccggtaccgggcccggtaccggtcgggcctcggttaccggtacggttacgtaaaccggtccttaaccgttccgttacgtcgttcggcggtttcgaggcggtcgggcgtaacggg

SEQ ID NO: 355613 - DNA, 593 bp, Homo sapiens
  misc_feature: GZ8MTXP01B05JQ.45.78.H01.1.454.CMB.2.raw
  modified_base (273)..(273): a, c, t, g, unknown or other
  misc_feature (273)..(273): n is a, c, g, or t
  modified_base (568)..(568): a, c, t, g, unknown or other
  misc_feature (568)..(568): n is a, c, g, or t
tcagacgcgatcgacacgaccggtgctcgatttagtgtgagtagtttgggtttgggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacgttgccggcagtcagtagtattagtactggttgctggtatcagacaagaaacgagggaaacnccctaagcctcctgctactagtaacggctattacgttaaggtttagaaaggttcgggtacccaagtacgtaaaggttcaggcggacgaggtaggatcgtagggaaactaagtaacttccaactctacaccatcagcagcctgacagctagtatgtatttgacttaattattactcggaactaagtagtatagtaacgtttagttacgttaccggtacgttaccgggaaccgtaaacggggacctaaaaggggtacgaaataccgaaaacgtacgtggttacggcttacgctaccnttctacgttcttaacgctttccccg

SEQ ID NO: 355614 - DNA, 530 bp, Homo sapiens
  misc_feature: GZ8MTXP01DZ6Q6.45.78.H01.1.454.CMB.2.raw
  modified_base (252)..(252): a, c, t, g, unknown or other
  misc_feature (252)..(252): n is a, c, g, or t
  modified_base (289)..(289): a, c, t, g, unknown or other
  misc_feature (289)..(289): n is a, c, g, or t
  modified_base (366)..(366): a, c, t, g, unknown or other
  misc_feature (366)..(366): n is a, c, g, or t
  modified_base (455)..(455): a, c, t, g, unknown or other
  misc_feature (455)..(455): n is a, c, g, or t
  modified_base (467)..(467): a, c, t, g, unknown or other
  misc_feature (467)..(467): n is a, c, g, or t
  modified_base (495)..(495): a, c, t, g, unknown or other
  misc_feature (495)..(495): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggcttntggatacaccttcaccggctactatatacactgggtncgacacggcccctggacgaagggcttggagtggagtgggatggatacaaacctaacaagtgtagacaacaaaactancgacaacgagtaagttcgagggcgagggtcaccagtcgacgaggacacgtcatcagcaacacgcctagagtggagcgtagagcgagcgngaaggtctacgnggaacgcacggtcgttagtaacgttcgngcgacgaagagaagagtagttagttaagttgtaag

SEQ ID NO: 355615 - DNA, 557 bp, Homo sapiens
  misc_feature: GZ8MTXP01DEMBX.45.78.H01.1.454.CMB.2.raw
  modified_base (228)..(228): a, c, t, g, unknown or other
  misc_feature (228)..(228): n is a, c, g, or t
  modified_base (528)..(528): a, c, t, g, unknown or other
  misc_feature (528)..(528): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagcctggggcctnagtgaaggtctcctgcaaggcttctggatacacttcaccggctactatatacactgggtgcgacacggcccctggacgaagggcttgagtggagtgggatggatacaaaccctaacaagtggtaggacaacgaaaactatgacaacgaagtaagtttcgagggcagggtcacgatagaccgagggacacgtaccatcagacacgacgcctacgaagtggagcgtgaagccgaggacggtgagtaagtcgtaggaacgacgacgggtccttaggttattaacgttgcggacgaaggagaanaaggagttaacgttgttttaagggtaagg

SEQ ID NO: 355616 - DNA, 612 bp, Homo sapiens
  misc_feature: GZ8MTXP01AXU80.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttagtcggaacgtatggacgtcgtggggccaaggggaccacggtcaccgtctcctcacgccctccaccgaacgggcccaacgtccgggtccttccccccgtcgggtccccaaccccggttccctcccgaaacgaccgccgaacccgtccgtacgggggccaccgacgcccgggccccgttggggccttcggcccgtcgggttccgaaacgggtaccttaccgttcccttcggtaactccgtcgtcgtcggacggtcgggcgtcgggg

SEQ ID NO: 355617 - DNA, 577 bp, Homo sapiens
  misc_feature: GZ8MTXP01D4KCJ.45.78.H01.1.454.CMB.2.raw
  modified_base (286)..(286): a, c, t, g, unknown or other
  misc_feature (286)..(286): n is a, c, g, or t
  modified_base (456)..(456): a, c, t, g, unknown or other
  misc_feature (456)..(456): n is a, c, g, or t
  modified_base (492)..(492): a, c, t, g, unknown or other
  misc_feature (492)..(492): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcaggtcaccatgaccaggacacgtcatcagcacagctacatggagctgagcaggctgagatcngacgacacggcgtagtattactgtgcgagagcaaggtaattacgtagttttggagttggttatcgggaaacgttagtcgggacgtcgtcggggacctaaacgggaccgacggtccaccgtctccacacgccctcgaaccgacgggcccagtccgtccctccccgtgcccncccgtctaccgaaagcgccaccgtcggcggggaccncgacggccgcccgtgggcctgccgtggttacaacggtaccttacgttccgttacgctccgtccgttgcggagccgggctaacggg

SEQ ID NO: 355618 - DNA, 604 bp, Homo sapiens
  misc_feature: GZ8MTXP01B4RKS.45.78.H01.1.454.CMB.2.raw
  modified_base (378)..(378): a, c, t, g, unknown or other
  misc_feature (378)..(378): n is a, c, g, or t
  modified_base (411)..(411): a, c, t, g, unknown or other
  misc_feature (411)..(411): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtagaagaagccgtggggcctgagtgagtctcctgcaaggcttcgtggactacaccttcgaccggtctactatatacacgtggtgcgacgcggcccctgggacgaagggtcttggagtgggagtgggatggactaccaaaccctaacgaagtggtagacaacaaaaatntgacaagagtaagttcgaggggcagggtcacancgacgaggacacgtcatacacgacaacgacgtacctaacgagtacgggacgcgtagacgacgacggacgtggaactagtccgaaggaaccggacgttaccgggtccgttaggttaaacttcgttagggttcggacggaagggtacggaacgtaagggttaacgtttacggttaaggtttttaaggggtaaggg

SEQ ID NO: 355619 - DNA, 564 bp, Homo sapiens
  misc_feature: GZ8MTXP01EWBDU.45.78.H01.1.454.CMB.2.raw
  modified_base (405)..(405): a, c, t, g, unknown or other
  misc_feature (405)..(405): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaaactatgcacagaagtttcagggcagggtcaccatgaccaggacacgtccatcagcacagcctacatggagctgagcaaggctgagatctgacgacacggccgtgtattactgtgcgagagcagaatacgtattttggagtggttatcggaacgtatggacgtgtggggccgaagggaccacggtcaccgtctcctcacgtccnccaaccgacgggcccatccggtcctcccccgtgcccacccgtcctaccaaacgacgccacccgtcgtgggggccacgtacgccggccccgtgggctgcccgtggttccgaacggtacttacgttccttcgaactcgcgtcgtgacgcggttcgaacggg

SEQ ID NO: 355620 - DNA, 590 bp, Homo sapiens
  misc_feature: GZ8MTXP01DHP03.45.78.H01.1.454.CMB.2.raw
  modified_base (198)..(198): a, c, t, g, unknown or other
  misc_feature (198)..(198): n is a, c, g, or t
  modified_base (253)..(253): a, c, t, g, unknown or other
  misc_feature (253)..(253): n is a, c, g, or t
  modified_base (269)..(269): a, c, t, g, unknown or other
  misc_feature (269)..(269): n is a, c, g, or t
  modified_base (385)..(385): a, c, t, g, unknown or other
  misc_feature (385)..(385): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtcctccttccaccctgtctgcatctgtagganacagagtcaccatcacttgccgggcagtcagtagtatagtactggtgctggtatnagcagaacaggaaacncccctaagcctctgctactataaggcattacgttaagtttagaaaggttcggggtcccagtacgaaggttcaggccggcagtgatcgtaagggacaagtaattcactctacactancagcagcctgcagctgattgtaatttcgacttaaactttacttacgtacgtacctaaacgtagttaatgtaatttagtttaacgttcggtaacggtttacgggaaccgtaaagggggtaaaccctaaaggggaggtaaaacttacgaaaacggtagttcggttgccgtaagaactaacgtatccttattcccttaacgttaaccc

SEQ ID NO: 355621 - DNA, 523 bp, Homo sapiens
  misc_feature: GZ8MTXP01B2VIJ.45.78.H01.1.454.CMB.2.raw
  modified_base (272)..(272): a, c, t, g, unknown or other
  misc_feature (272)..(272): n is a, c, g, or t
  modified_base (351)..(351): a, c, t, g, unknown or other
  misc_feature (351)..(351): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtattagtaactggtgctggtatcagcagaaaccagggaaacnccctaagctcctgctctataggcatctagtttagaaagtgggtaccatcaaggtcagccggcagtggatcgtagggacngtaattcactctcaccatcagcacgcctgcagcctgtatgtatttgacttaattattactgactaacagtatgtattagttacttcgtacgttcggacgaagggaacaaagggttaggaaattacgaaacgtacgttggttcgcgtgacctaacatcttcgttcttctaacc

SEQ ID NO: 355622 - DNA, 572 bp, Homo sapiens
  misc_feature: GZ8MTXP01A0RE5.45.78.H01.1.454.CMB.2.raw
  modified_base (558)..(558): a, c, t, g, unknown or other
  misc_feature (558)..(558): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaaattacggatttttggagttggttattcggaacggttagtgggacgtcgtgggggcctaaggggccacgggtcacccggtctacctcagcctcaccgaacgggcccatccggtcttccccctggcccacccgtcctccaacgacgtccacccgtcgtcgggggccacgacgcggccctggggcctggccctggttcgaaacggtcttacgttccttcgaatccgcgtcgtgnggtccgggcgtggg

SEQ ID NO: 355623 - DNA, 550 bp, Homo sapiens
  misc_feature: GZ8MTXP01BPWWZ.45.78.H01.1.454.CMB.2.raw
  modified_base (194)..(194): a, c, t, g, unknown or other
  misc_feature (194)..(194): n is a, c, g, or t
  modified_base (270)..(270): a, c, t, g, unknown or other
  misc_feature (270)..(270): n is a, c, g, or t
  modified_base (531)..(531): a, c, t, g, unknown or other
  misc_feature (531)..(531): n is a, c, g, or t
tcagacgcgatcgacacgaccggtgctcgatttagtgtgagtagtttgggtttgggggtcagacccagtcaggacacagcatggacatgagggtccccgctcagctcctggggctcctgctgctctggctcccaggtgccaaatgtgacatccagatgacccagtctccttccacctgtctgcatctgtagganacagagtcaccatcacttgccggcagtcagagtattagtactggttgctggtatcagacaagaaacgagggaaacncccctaagcctcctgactactaagtaagctattacgttaaggtttaaggaaacggttcgggtaccctaagtacgtaaggttcaggcggacaggtggatcgtaggaaacagtaattcactctacacatcagcagctgcacgtctagattgtatttcgactaacttatactcggaactaagtatatatattagttacgtacgtacgttcgacgtaaggactaaggtagaaactacaaacgtagtgttacggcttacgcacctnttctgttctcttcgttccc

SEQ ID NO: 355624 - DNA, 526 bp, Homo sapiens
  misc_feature: GZ8MTXP01ENH4L.45.78.H01.1.454.CMB.2.raw
  modified_base (358)..(358): a, c, t, g, unknown or other
  misc_feature (358)..(358): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacacgtgggtgcgacacggcccctggacaagggcttgagtggatgggatggatcaacctaacaatggtgcaacaaaaactntgcaacagagtttcgaggggcagggtcacatcgacgagggacacgtcatcagcacagcctacgatggagctgagcgaggctgagatctggaacgacgacggtccgttagttagttacgttggttgacgaaggaggaacgaggtaagttacgttaagttttggtaaggg

SEQ ID NO: 355625 - DNA, 511 bp, Homo sapiens
  misc_feature: GZ8MTXP01DOT1V.45.78.H01.1.454.CMB.2.raw
  modified_base (470)..(470): a, c, t, g, unknown or other
  misc_feature (470)..(470): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacctaacaatggtgccacaaactatgcaacagaagtttcagggcagggtcacatcgaccaggacacgtcatcagcacagcctacataggagcgtgagcaggctgagatctgacgacgacggccgtgtattacgtgttgcgaggaggnaggaattagtaagttttggagttggttaagttcggtaacgg

SEQ ID NO: 355626 - DNA, 609 bp, Homo sapiens
  misc_feature: GZ8MTXP01C88XX.45.78.H01.1.454.CMB.2.raw
  modified_base (187)..(187): a, c, t, g, unknown or other
  misc_feature (187)..(187): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaanaatggtggcaacaaactatgcacagtaagtttcagggcagggtcaccatgaccagggacacgtccatcagcacagcctacatggagctgagcaggctgagatctgacgacacggccgtgtattactgtgcgagagcgaggtattacgtagttttggagttggttatcggaacggtatggacgtcgtggggaccgagggaaaaccgcggtacaccgtctcctcacgccctccgaaccgacgggccctacgtcccggtccttcccctcggcccaccctcctacccaagaccgcctacccgtcgtcgggggccacgacggccggcccgtgggcctcggccgtcggaccgtaacgggtaccttaccgttccgttaccggtaacgttccggtccggttcgtcggacgggtccgggaaccggtcgggg

SEQ ID NO: 355627 - DNA, 583 bp, Homo sapiens
  misc_feature: GZ8MTXP01C7RUQ.45.78.H01.1.454.CMB.2.raw
tcagacgcgatcgacacgaccggtgctcgatttagtgtgagtagtttggggttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtatactgtgcgagaggcaggattacgtagttttggagttggttattcggaacggttatgggtacgtcgtggggaccgaacggggaccacgggtcaccgtctccgtcacgcctacccaccgaacgggcccacgtccgtccttccccctcgggcccacccgtcccttcccgaaacgacgccacccgtccgtgggggaccacgacgcggcccgtgggctcgccgtcggttcgaacgggtccttacgttccttcgaactcgcgtcgtcgacgcgggcgtcggg

SEQ ID NO: 355628 - DNA, 695 bp, Homo sapiens
  misc_feature: GZ8MTXP01DIP4U.45.78.H01.1.454.CMB.2.raw
  modified_base (253)..(253): a, c, t, g, unknown or other
  misc_feature (253)..(253): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtacaaagcctcctatacgaggggataggaaacnctcacttgaatttggttacaaacagacggccaggccaatctaccaaggcgaccttaaatttagtaaaggtttccaaaccggggactcgtcggggtacccaagacagacttcgagcggacaggtgggtcaaggcaaacgttgtaactttacaaacgtaaacgttaaggtaaaaacgtttaggggtaagggggtagggaacggtcgttagggaagggttaattgggtttagggttaagttttacttttcgtggactagttgacgtaaaggtaaccaacgtacgttcggtacccgttaacgttacgttttcgggaccgaaacgggggacctaaaggtaccgtaagggaaaattaaccgaaaaacgttacggttaggttcgggtacctcggaccacccttagttccgtacgttcctttacactttcccgttaaccccgcgttaacg

SEQ ID NO: 355629 - DNA, 546 bp, Homo sapiens
  misc_feature: GZ8MTXP01DO0TQ.45.78.H01.1.454.CMB.2.raw
  modified_base (291)..(291): a, c, t, g, unknown or other
  misc_feature (291)..(291): n is a, c, g, or t
  modified_base (380)..(380): a, c, t, g, unknown or other
  misc_feature (380)..(380): n is a, c, g, or t
  modified_base (434)..(434): a, c, t, g, unknown or other
  misc_feature (434)..(434): n is a, c, g, or t
  modified_base (458)..(458): a, c, t, g, unknown or other
  misc_feature (458)..(458): n is a, c, g, or t
  modified_base (480)..(480): a, c, t, g, unknown or other
  misc_feature (480)..(480): n is a, c, g, or t
  modified_base (523)..(523): a, c, t, g, unknown or other
  misc_feature (523)..(523): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcgagtgaaggtctcctgcaaggcttcgtggatacacccttcaccggctactatatacacgtggngcgacacggcccctggacaagggcttggagtgggagtgggattggactaccaaacccgtaacaagtggtaggacaaacaaaaaacttancgacaacagtaaagtttcgaggggcagggtcacatcgacgagggacacgtacancagacacacgacctagagtggaancgagagcgaggactgagactcngaacgacgacggtcgttagttattgttagttgacgaagacggngaggattagtgttttggtaaggg

SEQ ID NO: 355630 - DNA, 609 bp, Homo sapiens
  misc_feature: GZ8MTXP01CJFYW.45.78.H01.1.454.CMB.2.raw
  modified_base (448)..(448): a, c, t, g, unknown or other
  misc_feature (448)..(448): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatggagctgagcgaggctgagatctgacgacacggccgtagtattacgtgtgcgagagcaggaattacgtactttttggagttggttatcggaaacgtatggacgtcgtggggaccaagggaccgacggtcaccgtctcctcacgccctaccaccgaacgggcccagtccggtccttcccccncggtcccaccctcccgtaccaacgacgccacccgtcggcggggaccacgacggcccggcccgtcggggcctcgcccgttagggaccgaaacgggtacccttaccgtttcccttaccggaacgtcccggtcgttcccggtcggacggtccgggttcggtcgg

SEQ ID NO: 355631 - DNA, 682 bp, Homo sapiens
  misc_feature: GZ8MTXP01A5A61.45.78.H01.1.454.CMB.2.raw
  modified_base (261)..(261): a, c, t, g, unknown or other
  misc_feature (261)..(261): n is a, c, g, or t
  modified_base (556)..(556): a, c, t, g, unknown or other
  misc_feature (556)..(556): n is a, c, g, or t
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtagaagaacgccgtggggcctgagtgaacggtctccgtgcgaaggtcttcgnggactacctacccttcgaccggtactaacttatactacgacgttggggtcgaccgaacgaccgggtcccccgtagggaaccggtaaggggtcttaggaggttagggaggttgggggtatcggaactaccgtaaaccctaaacgagtcggtataccaaacgtaaaaacttagtcgaccaaagtagttaacgttcgacggggactacgggtaccaacgtagtaacgacgaaacgggacctaaccggtacactacgaacgaccaacgaccgacccgttaagacggtacggacgtacgngggaacgcggacggtcgtagaacgctacgcggaaccgcgggttaccggtacgttacgtaagttccggttacgttgggaggaacgtagggcgtaaggttacgttaagggtttgtttaagggtaaggg

SEQ ID NO: 355632 - DNA, 550 bp, Homo sapiens
  misc_feature: GZ8MTXP01BR53M.45.78.H01.1.454.CMB.2.raw
  modified_base (520)..(520): a, c, t, g, unknown or other
  misc_feature (520)..(520): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctggacaagggcttggagtggagtgggatggataccgaaaccctaacaagtggtggacaacaaaaactatgcaacgaagaagtttcgaggggcgagggtacacatgacgagggacacgtccatcagcacagacctacagtggacgcgtggaacgccgaggcgtaggagacgtcgaggaacgaacggacggtccgttagtattacgttggttcgcgaagacgngaaggtaattacggtaagttttggtaaggg

SEQ ID NO: 355633 - DNA, 637 bp, Homo sapiens
  misc_feature: GZ8MTXP01BPC0L.45.78.H01.1.454.CMB.2.raw
  modified_base (505)..(505): a, c, t, g, unknown or other
  misc_feature (505)..(505): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtcatcagcacagcctacatggagctgagcaggctgagatctagacgacacggccgtgtattactgtgcgagaggcaggattacgtattttggagttgttagtcggaacggtagtggacgtcgtggggaccgaacgggaccgtacgggtccaccgtctccctacacgccctccaaccgaacgggccctacgtccggtcccttcccccgtaggccccacccgtccctaccgaacgacgccacccgttcggcgggggaccncgacggcccggcccgttggggccctcggccccggttaggttacccgaaacgggtaccctttaaccgttcccgttacggtaaccttccggccgtttcgtacggggttacgggcccgggggttcgtaaccgggg

SEQ ID NO: 355634 - DNA, 529 bp, Homo sapiens
  misc_feature: GZ8MTXP01A7XT5.45.78.H01.1.454.CMB.2.raw
  modified_base (290)..(290): a, c, t, g, unknown or other
  misc_feature (290)..(290): n is a, c, g, or t
  modified_base (420)..(420): a, c, t, g, unknown or other
  misc_feature (420)..(420): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaggtctcctgcaaggcttctggatacaccttcaccggctactatatacactgggtgcganaggcccctggacaagggcttgagtggatgggatggatcaacctacaatggtgcacaaaactatgcacagaagtttcagggcagggtcaccgatgacagggacacgtcaatcagcacagcctacatgggancgtagagcgaggcgagtagatcgagaacgacgaccgggtcgttagtacgttacgttggttggacggaaggacggaacgtaagggtaagttacgttaagttttggtaagg

SEQ ID NO: 355635 - DNA, 529 bp, Homo sapiens
  misc_feature: GZ8MTXP01A2DFX.45.78.H01.1.454.CMB.2.raw
  modified_base (290)..(290): a, c, t, g, unknown or other
  misc_feature (290)..(290): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (453)..(453): a, c, t, g, unknown or other
  misc_feature (453)..(453): n is a, c, g, or t
  modified_base (461)..(461): a, c, t, g, unknown or other
  misc_feature (461)..(461): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggggcctcagtgaaggtctcctgcaagggcttctggatacaccttcaccggctactatatacactggggtncgacaggccccctggacaagggcttgagtggatggggatggatcgaacccctaacaaatgggtggacacaaaaactatgcaacagaagtttcaggggcagggtcaccgatgacagggacaacggtccatcagcacagccctaagagtggncgngngngagcgngagatcgngaacgacgacggcgttgtactagttcgngnggaaggaggaagaggtagttacgttaagtttggtaagg

SEQ ID NO: 355636 - DNA, 618 bp, Homo sapiens
  misc_feature: GZ8MTXP01BN23D.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggcgtgtattactgtgcgagagcaggtattacgtattttggagtggttatcggaaagttatcgggagtcgtggggaccaagggcctacggtcaccgtctccctcacgccctaccgaaccgacgggccctacgtccgggtcccttccccccgtggccccacccctcccgtaccgaaacgccgccaacccgttcggtacgggggccacgacgggcccggtcccgttgggggccttcgggcccgttcgggttacgaaacgggtcttacccgtttcccgcggtaactccggtccgttcgcggacgggcggggttcccgtgggg

SEQ ID NO: 355637 - DNA, 545 bp, Homo sapiens
  misc_feature: GZ8MTXP01EOVLB.45.78.H01.1.454.CMB.2.raw
  modified_base (422)..(422): a, c, t, g, unknown or other
  misc_feature (422)..(422): n is a, c, g, or t
  modified_base (443)..(443): a, c, t, g, unknown or other
  misc_feature (443)..(443): n is a, c, g, or t
  modified_base (467)..(467): a, c, t, g, unknown or other
  misc_feature (467)..(467): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggcctcagtgaaggtctcctgcaaggcttctggatacaccttcaccggctactatatacactgggtgcgacacggcccctggacaagggcttgagtgagtgggatggatacaaccctaacagtggtacgacaacaaaaactatgacaacgaagtaagtttcgagggcagggtcacagtacgacgagggactacgtccatcacncacacgacctacgataggganacgtgagcgagcgtagagactcgngtaaccgcgaccggtcgttagtacgttagttgcgcggaagaggaactaggggtaattaggtttaagtttgggttaagg

SEQ ID NO: 355638 - DNA, 575 bp, Homo sapiens
  misc_feature: GZ8MTXP01AD730.45.78.H01.1.454.CMB.2.raw
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtagaagaagccgtggggcctcagtgaggtctctgcaggcttctggatacaccttcaccggtctactatatacacgtgggtcgcgacgcggccccgtggacaggggtcttggaggtgggagtgggatgggaactacaaaccccgtaaacaaggtgggtcggaccaacgtaaaaactgtcgacaacgagtaacgttcgagggcagggtccacgatgaccgagggacacgtccatcagctaacacgcctaggagtcgggatcgagcgactacgggctggaagattcgaggaaccgcgaccgggtccgttgttaacgttacgttggcgacggaaggaggtgtaaggtagttacggttaagttttggtaaggg

SEQ ID NO: 355639 - DNA, 617 bp, Homo sapiens
  misc_feature: GZ8MTXP01DMGCE.45.78.H01.1.454.CMB.2.raw
  modified_base (469)..(469): a, c, t, g, unknown or other
  misc_feature (469)..(469): n is a, c, g, or t
tcagacgcgatcgacacgaccggtgctcgatttagtgtgagtagtttgggtttggggtgaagaggcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctagacgacacggccgtgtatactgtgcgagagcaaggattacgtagttttggagttggttatcggtaacgttagtgggtacgtcggtcggggacctaaacggggacctacgggtccacccgttcctccgtcgaccgcccccaaccgaaacgggcccctagtcccggtcccttcccccgnggccctaccccgtcctaccaacggaccgccaccgtcgtcggggcaaccgcggccggtcccgtgggccgtcgccgttcggtaccgaaacggtaccttaaccttccgttcgacgttccggcgttcgtcggacggcgggcgttggaaccgg

SEQ ID NO: 355640 - DNA, 598 bp, Homo sapiens
  misc_feature: GZ8MTXP01EFQWT.45.78.H01.1.454.CMB.2.raw
  modified_base (288)..(288): a, c, t, g, unknown or other
  misc_feature (288)..(288): n is a, c, g, or t
  modified_base (471)..(471): a, c, t, g, unknown or other
  misc_feature (471)..(471): n is a, c, g, or t
tcagacgcgatcgacacgaccggtgctcgatttagtgtgagtagtttgggttggggtgagaagcctgggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatcngacgacacggccgtgtattactgtgcgagaggcagaattacgtattttggagtcggttatcgggaacggtatgggactcggtggggaccaaggggacctacggtctaccgtctacctcagcctccgaccgaagggcccactccggtccttcccccgtggcccacccgtccctccaaaggaccnccgaccgtcggtcggggaccacgcggtccggtcccgtcgggtcctcggccgtcgggttacgtaacggtaccttacgttcccgttcgtaacgtccggtcgttcggtcggacgggtccgggttcgtggg

SEQ ID NO: 355641 - DNA, 590 bp, Homo sapiens
  misc_feature: GZ8MTXP01EDELL.45.78.H01.1.454.CMB.2.raw
  modified_base (284)..(284): a, c, t, g, unknown or other
  misc_feature (284)..(284): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggcngagatctagacgacacggccgtgtattactgtgcgagagcaggaattacgtattttggagtggttatcggaacgtatggacgtcgtggggaccaaggggaccacgggtcacccgtctcctcgacgccctaccgaaccgaacgggcccacgtccggttcccttcccccgtcggcccaccccgttccctccaaacgcgccacctcggtcgggggccacgcggcccggccgtcggggcctcggccgtcggttacgaacgggaccttaccttccgttcgcttccggcgttcggtcggcggtcggcgtcgg

SEQ ID NO: 355642 - DNA, 521 bp, Homo sapiens
  misc_feature: GZ8MTXP01AWIRF.45.78.H01.1.454.CMB.2.raw
  modified_base (290)..(290): a, c, t, g, unknown or other
  misc_feature (290)..(290): n is a, c, g, or t
  modified_base (440)..(440): a, c, t, g, unknown or other
  misc_feature (440)..(440): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
  modified_base (476)..(476): a, c, t, g, unknown or other
  misc_feature (476)..(476): n is a, c, g, or t
  modified_base (484)..(484): a, c, t, g, unknown or other
  misc_feature (484)..(484): n is a, c, g, or t
  modified_base (490)..(490): a, c, t, g, unknown or other
  misc_feature (490)..(490): n is a, c, g, or t
  modified_base (495)..(495): a, c, t, g, unknown or other
  misc_feature (495)..(495): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttcgtggatacaccttcacccggctactatatacactgggtncgacaggccccctggacaagggcttggagtggatgggatggactaccgaaacctaaccaatggtaggcaacgaaaactatgacaacaggtaagttcgagggcagggtcacatgaccgagggacacgcatcagcacagcctacgatgggancgtgagcgagcgtgagntcgngaacgcgacgggtcngtatacgngttcgngaagngcgtagtagttagtgttttggtaagg

SEQ ID NO: 355643 - DNA, 613 bp, Homo sapiens
  misc_feature: GZ8MTXP01DP6DL.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctggacaagggcttggagtggagtgggatggatacaaacctaacaatggtagacaacaaaaaactatgacaacaagtaaagtttcgaggggtacacgggtacaaccagtacgaaccgaagggaacaaccggttaccaatcaacgacaacgacgacctaacgagttagggacgtcgtagaacggcgaagggaccgtagaaggtaactcgtacggaacggtaacgaccgggtaccgttaggtaacgtttaacgttgttcggacggaagggacggaacgtaagggtaaacgtttacggttaagtttttgggttaaggg

SEQ ID NO: 355644 - DNA, 576 bp, Homo sapiens
  misc_feature: GZ8MTXP01AFPFP.45.78.H01.1.454.CMB.2.raw
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttctggatacaccttcaccggctactatatacacgtggtgcgacgacggcccctaggacagggctggagtggagtgggatggactacaaccgtaacagtggtacgacaacaaaactatgacaacgagtacgtttcgagggcacgggtacacgagtacgacgaggacacgtacatcacgacacgacgtacctacgagtggacgacgtagagcgaacggtctaggagtacgtccgtaggaaccgacgacgggtccgttagttacgttacgttcggttcgacggtaaggaggtaacgaagggttaacgtttaggttaagttttgggtaagg

SEQ ID NO: 355645 - DNA, 564 bp, Homo sapiens
  misc_feature: GZ8MTXP01CE6BV.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtattactgtgcgagaggcaggattacgattttggagtggttattcggaacggttatggacgtcgtggggccaaggggccacggtcaccgtctcctcacgcctccaccaacgggccccagtccggtccttccccctggcccacccgtcctcccaacgacgccacccgtcgtcgggggccacgacgccggcccgtgggcctcggccgtggttcgaaacgggtcttaccgttccttcgaatcgcgtctgcggcggcgtggg

SEQ ID NO: 355646 - DNA, 538 bp, Homo sapiens
  misc_feature: GZ8MTXP01EHZ05.45.78.H01.1.454.CMB.2.raw
  modified_base (510)..(510): a, c, t, g, unknown or other
  misc_feature (510)..(510): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggcttctggatacaccttcaccggctactatatacacgtgggtgcgacgacggcccctggacaagggcttgagtggagtgggatggatacgaaaccctaacgaagtggtagacaacaaaaactatgacaacgagtaagttcgagggcagggtcacatgacaggacacgtcatcagcacacgcctacgatggagcgtgacgcgagcgtgagactcgtgaacggtacgcggtccgttagtacgtaacgttggttgacgaaggaggngaagggtattaggtaagttttggtaagg

SEQ ID NO: 355647 - DNA, 577 bp, Homo sapiens
  misc_feature: GZ8MTXP01A60WR.45.78.H01.1.454.CMB.2.raw
  modified_base (289)..(289): a, c, t, g, unknown or other
  misc_feature (289)..(289): n is a, c, g, or t
  modified_base (399)..(399): a, c, t, g, unknown or other
  misc_feature (399)..(399): n is a, c, g, or t
  modified_base (506)..(506): a, c, t, g, unknown or other
  misc_feature (506)..(506): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtcatcagcacagcctacatggagctgagcgagctgagatcgngacgacacggctgtatactgtgcgagagcaggtaattacgtattttggagttggttatcggaacgtatggacgtcgtcggggaccaagggccacggtccaccgtctcccncgacgccctaccgaccgaacgggccctagtccggttcccttccccgtcgcccaacccgtccctccaaacgcgaccaccgtcgcggggccacgcggccggtccccggngggcctcggccgtcggacgtaacggtccttccgttccgcgtgtccgtcgtacgtcggcggtcgggcgtcgg

SEQ ID NO: 355648 - DNA, 632 bp, Homo sapiens
  misc_feature: GZ8MTXP01B8M5N.45.78.H01.1.454.CMB.2.raw
  modified_base (284)..(284): a, c, t, g, unknown or other
  misc_feature (284)..(284): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaaccctaacaatggtggcacaaactatgcacagaagtttcagggcagggtcaccatgaccagggacacgtccatcagcacagcctacatggagctgagcgaggntgagactctagacgacacggccgtgtattactgtgcgagaggcaaggtattacgtagtttttgggagttggttaagttcggaacggttagtgggacgtcggtagggggaccaaggggaccgacgggtcacccggtctcctcgacgccctaccgaccgaaacgggccccacgttccggtcccttcccccgtggaccccaccccgtcccgttacccaaacgaccggacctacccgttccgcgggggacccacgtccggccgggccccgtggggcctcggccgtcggttacgaacggtaccttaccgttccgttcgtaacgtccgtcgttcggcggacggtcgggcgtcgg

SEQ ID NO: 355649 - DNA, 554 bp, Homo sapiens
  misc_feature: GZ8MTXP01EI3ZR.45.78.H01.1.454.CMB.2.raw
  modified_base (245)..(245): a, c, t, g, unknown or other
  misc_feature (245)..(245): n is a, c, g, or t
  modified_base (277)..(277): a, c, t, g, unknown or other
  misc_feature (277)..(277): n is a, c, g, or t
  modified_base (514)..(514): a, c, t, g, unknown or other
  misc_feature (514)..(514): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagaagccgtgggcctgagtgagtctctgcagtctntgatacactcacgctactatatacacgtggtncgacgacggcccctaggacgaaggtctgagtggagtgggatggatacaacctaacaagtggtagacaactaaaaactatcgacaactaaggtaagtttcgaaggggtacgtacggggtaccaaccgtagtacggaaccgacgggaacaccggttaccatacagacacagaccctagagtggagcgtagagcgagtcgagtagactcgagaacgacgacgtcgttagtagtacttggngaggngaggngtaaggtagttacgttaagttttggtaagg

SEQ ID NO: 355650 - DNA, 513 bp, Homo sapiens
  misc_feature: GZ8MTXP01EVVTG.45.78.H01.1.454.CMB.2.raw
  modified_base (433)..(433): a, c, t, g, unknown or other
  misc_feature (433)..(433): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
  modified_base (454)..(454): a, c, t, g, unknown or other
  misc_feature (454)..(454): n is a, c, g, or t
  modified_base (490)..(490): a, c, t, g, unknown or other
  misc_feature (490)..(490): n is a, c, g, or t
  modified_base (512)..(512): a, c, t, g, unknown or other
  misc_feature (512)..(512): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagagcaggaattacgattttggagtggtatcggaacgtatggacgtcgtggggccaaaggggaccacgggtcaccgtctcctcagcctcaccaagggccatcgctcccctgcaccnctccangcnctctggggcacngcgcctgggctgccgtggttcaaggacttacttccncgaatcgcgtctgagcgggcgng

SEQ ID NO: 355651 - DNA, 537 bp, Homo sapiens
  misc_feature: GZ8MTXP01CVTSV.45.78.H01.1.454.CMB.2.raw
  modified_base (225)..(225): a, c, t, g, unknown or other
  misc_feature (225)..(225): n is a, c, g, or t
  modified_base (431)..(431): a, c, t, g, unknown or other
  misc_feature (431)..(431): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctnagtgagtctctgcagtctctggatacaccttcaccggctactatatacactgggtgcgacaggcccctggacaagggcttggagtggagtgggatggatcaacctaaccaagtggtggacaacaaaaactatgacaacgaagtaagtttcgagggtcagggtacacatgacgagggacacgtcatcagcacagcctagacgtggancgtgagcaggctgagatcgtagaacgacgacgggtccgttagttaacgttacgttaggttgacggaagacgggcaagggtaattacggttaagtttttgggtaagg

SEQ ID NO: 355652 - DNA, 529 bp, Homo sapiens
  misc_feature: GZ8MTXP01EC9X2.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctggacaagggcttgagtggatgggatggatcaacctaacaatggtggcaacgaaaactatgcaacagtaagtttcgaggggcagggtcacatgacagggacacgtcatcagcacagacctacgagtggagcgtgacgcgaggactgagactcgaggaacgacgacggtccgttgtattacgttgttgacggaaggaggaacgaggtaattagttaagttttgggtaaggg

SEQ ID NO: 355653 - DNA, 579 bp, Homo sapiens
  misc_feature: GZ8MTXP01AXFGL.45.78.H01.1.454.CMB.2.raw
  modified_base (272)..(272): a, c, t, g, unknown or other
  misc_feature (272)..(272): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcaggctgagatctgacgacacggccgtgtattactgtgcgagagcaggaattacgattttggagttggttattcggaaacgggtatgggacgtcgtgggggacctaaggggaccacgggtcaccgtctcctcacgcctaccaccgaacgggcccctagtccgggtccttcccccgtcggacccaccccgtcctcccgaagtcggccaacccgtcgtcgggggccacgacggcccggcccgtgggcctggccgtggttcgaaggccttacgttccttcgaatcgcgtctgacgtcggcgtcgg

SEQ ID NO: 355654 - DNA, 517 bp, Homo sapiens
  misc_feature: GZ8MTXP01ELNWZ.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctggacaagggcttggagtggatgggatggatcaacctaacatggtggcaacaaaactatgacacagaagtttcagggcagggtcacatgacgaggacacgtcatcagcacagcctacgagtggagctgagcgaggctgagatctgaacgacgacggccgttgtattcgttagttgacgaaggaggaacgaggtaacttaggtaagtttttggtaaggg

SEQ ID NO: 355655 - DNA, 669 bp, Homo sapiens
  misc_feature: GZ8MTXP01CMSTD.45.78.H01.1.454.CMB.2.raw
  modified_base (272)..(272): a, c, t, g, unknown or other
  misc_feature (272)..(272): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcaggctgagatctgacgacacggccgtgtattactgtgcgagaggcaggattacgtatttttgggagttggttattcgggaacggttatgggacgtcgtgggggcaaggggaccacgggtcacccgtctccctcgacgcctacccacctaacggggccccaagtccggtccttcccccgtcgggccctacccctccccttaccaaacgacggcctaccccgtccgtcggggggaccaaccggtacggcccggggtccccgttcgggggcccgttcgggttcccggttacggggttaccgtaaaaccggggtacccttaacccgtttcccgttaggtaaccgttccggtccggttccggttacggacggggtccgggggttccgttccggggg

SEQ ID NO: 355656 - DNA, 528 bp, Homo sapiens
  misc_feature: GZ8MTXP01DI59J.45.78.H01.1.454.CMB.2.raw
  modified_base (289)..(289): a, c, t, g, unknown or other
  misc_feature (289)..(289): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (509)..(509): a, c, t, g, unknown or other
  misc_feature (509)..(509): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggcttctggatacaccttcaccggctactatatacactgggtncgacaggcccctaggacaagggcttgagtggagtgggatggatcaacctaacaatggtgacaacaaaaactatgacaacaagtaagtttcgaggggtcaagggtcacgatcgaaccaagggacaacgtccaatacagacacaagccctaacgatagggancgnggagcgaggtcgagagagctaggaacgacgacggcgttgtatattggngngaagagngagtagttagtaagttgtg

SEQ ID NO: 355657 - DNA, 564 bp, Homo sapiens
  misc_feature: GZ8MTXP01AHK5T.45.78.H01.1.454.CMB.2.raw
  modified_base (259)..(259): a, c, t, g, unknown or other
  misc_feature (259)..(259): n is a, c, g, or t
  modified_base (348)..(348): a, c, t, g, unknown or other
  misc_feature (348)..(348): n is a, c, g, or t
  modified_base (405)..(405): a, c, t, g, unknown or other
  misc_feature (405)..(405): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagcctggggcctcagtgaaggtctctgcaaggcttcgtggatacnccttcaccgctactatatacactgggtgcgacgacggcccctaggaccgaagggcttgaggtggagtgggatggatacaaacccgtaanaagtggtacggacaacaaaaactatgacaacgagtagttcgagggcagggtcacganacgaccgagggacacgtcatcagcacgacgaccacgagtggacgacgtagacgcgaggtacgtaggagtacgtcgacggaacgacgaccggtcgttagttacgtacgttgcggacgaaggaggaacgtaaggtaacgttagttggtttaaggttaaggg

SEQ ID NO: 355658 - DNA, 738 bp, Homo sapiens
  misc_feature: GZ8MTXP01C6GRE.45.78.H01.1.454.CMB.2.raw
  modified_base (229)..(229): a, c, t, g, unknown or other
  misc_feature (229)..(229): n is a, c, g, or t
  modified_base (343)..(343): a, c, t, g, unknown or other
  misc_feature (343)..(343): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctnagtgaaggtctcctgcaaggcttctggatacaccttcaccggtctactatatacacgtgggtgcgacacggcccctggacgaaggctgagtggatgggatggatcaaccctaanagtggtgacaacaaaactatgacaacaagtaacgtttcgaggggacgaggggtacaacgagtacggaaccgaacggggaaccaccggttaccaactaccgaacgaccaacaacggtaccccttaaacggaacgttacggggtaaacgtaccgtaggaacgacccggtaaggggaccgttaggaaacgggtaacttacccggttaacggggaaaccccggaaaccgggttaacccgggggtaccccgggtttaacgggtttaaagttttaacccggttaagggttcgggttaacccgggtaaagggggaaacggggtaacccggtaaaacgggggtttaaacggtttttaaacggggttttaacggggttttttttaagggggttttaaagggggg

SEQ ID NO: 355659 - DNA, 523 bp, Homo sapiens
  misc_feature: GZ8MTXP01DCNU7.45.78.H01.1.454.CMB.2.raw
  modified_base (270)..(270): a, c, t, g, unknown or other
  misc_feature (270)..(270): n is a, c, g, or t
  modified_base (286)..(286): a, c, t, g, unknown or other
  misc_feature (286)..(286): n is a, c, g, or t
  modified_base (428)..(428): a, c, t, g, unknown or other
  misc_feature (428)..(428): n is a, c, g, or t
  modified_base (440)..(440): a, c, t, g, unknown or other
  misc_feature (440)..(440): n is a, c, g, or t
  modified_base (494)..(494): a, c, t, g, unknown or other
  misc_feature (494)..(494): n is a, c, g, or t
  modified_base (509)..(509): a, c, t, g, unknown or other
  misc_feature (509)..(509): n is a, c, g, or t
tcagacgcgatcgacacgaccggtgctcgatttagtgtgagtagtttgggtttgggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagagtattagtaactggttgctggtatcagcagaaaccagggaaacnccctaagctcctgctntaataaggcatcttaaggtttaagaaaggttcggggtacccagtacgaaggttcaggcggacaggtggatcgtagggaacaagtaacttcactctacacatcagcagcctgcagcctagtatgtatttgactaattattacngaccaatagtangtatagtattacgacgttcggacaagggacaaaggtagaaatacaaacgtatgngcttgcactaatctnttcttcaacttccc

SEQ ID NO: 355660 - DNA, 558 bp, Homo sapiens
  misc_feature: GZ8MTXP01CB2BN.45.78.H01.1.454.CMB.2.raw
  modified_base (225)..(225): a, c, t, g, unknown or other
  misc_feature (225)..(225): n is a, c, g, or t
  modified_base (244)..(244): a, c, t, g, unknown or other
  misc_feature (244)..(244): n is a, c, g, or t
  modified_base (365)..(365): a, c, t, g, unknown or other
  misc_feature (365)..(365): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagcgtgggcctnagtgagtctctgcagctcngatacacctcacgctactatatacactgggtgcgacacggcccctggacgaagggcttggaggtgggagtgggggtagatacgaaaccctaacaagtggtaggacaacaaactaatagcanaagtaagttcgagggcagggtcaccagtagaccgaggaccacgtacatcacgcacacgtacctacgaggtggagacgtgaacggccgaagggctaggagtagtacgtaggaaccgaacggacggccgtagttagttacgtgttaggcgaggaagacgaagggtaattaggttagttttgggaaggtttaaggg

SEQ ID NO: 355661 - DNA, 524 bp, Homo sapiens
  misc_feature: GZ8MTXP01BMGXT.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaggtctcctgcaaggcttctggatacaccttcaccggctactatatacactgggtgcgacacggccccctggacaagggcttggagtggatgggatggatcaacctaacagtggtggacacaaaactatgcacagtaagtttcgaggggcacgggtcacatgacgagggacacgtcatcagcacacgcctacgagtggagcgtgagcgaggcgtgagactcgtgaacgacgacggccgttgtacttacttggttgcgaaggaggcgaaggtattacggttaagttttggtaagg

SEQ ID NO: 355662 - DNA, 612 bp, Homo sapiens
  misc_feature: GZ8MTXP01DQSM9.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatggagctgagcaggctgagatctgacgacacggccgtgtattacgtgtgcgagaggcaggtaattacggtattttggagttggttattcggaacggttatgggactcgtggggaccaaggggccacggtcaccgtctcctcacgcctacccaaccgaacgggcccacgtccggtcccttcccccgtggacccacccctccttacccgaaacgacgccgacccgttcgcgggggaccacgacgcccgggcccgtggggtcctcggcccgttcgggttccgaaacgggtccttaaccgttcccgttacgtaactccggtccgttcgtcggacgggccgggcgtcgggg

SEQ ID NO: 355663 - DNA, 658 bp, Homo sapiens
  misc_feature: GZ8MTXP01DRJ4L.45.78.H01.1.454.CMB.2.raw
  modified_base (249)..(249): a, c, t, g, unknown or other
  misc_feature (249)..(249): n is a, c, g, or t
  modified_base (393)..(393): a, c, t, g, unknown or other
  misc_feature (393)..(393): n is a, c, g, or t
tcagacgcgatcgacacgaccggtgctcgatttagtgtgagtagtttgggtttgggaggactcctcagttcaccttctcacaatgaggctccctgctcagctcctggggctgctaatgctctgggtcccaggatccaggtggggatgttgtgatgactcagtctccactctccctgcccgtcacccttggacagccgcctccatctcctgcaggtctagtcaaagcctctatacgagggatggaaaacnctcacttgaaatttggtttacaacagaggccaggaccaatcctaccaaaggcgaccttaaatttagtaaacggttttcctaaaccgggacttcgtcgggggtaccccagacagtattcgagcggcaggtgggtcaggcaactgntttcactaactagtaaaattggtagggtagaggctggaggattggttaggttaacgttttatttcgtgcgtagtggacgtaaagggttaacacgtacgttacgggaccctttaacgtaccgttttgggacccgaaagggggtacctaaaggtccgttaagggaaaacttaaccgaaaacggttaaacgttgggttagggaccttaggaccttaacccgttattaacctcgttccttacgtaccttcctttccccggaacttaacg

SEQ ID NO: 355664 - DNA, 705 bp, Homo sapiens
  misc_feature: GZ8MTXP01DGMBT.45.78.H01.1.454.CMB.2.raw
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtagaagaagcgtgggcctcgagtgaaggtctcctgcaaggtcttctggatacaccttcaccggctactatatacacgtgggtgcgacgacggcccctggaacgaaggggcttggaggtggagtgggataggaactaccaaaccctaagaaagtgggtacggaccccaaactaaaactagtacgacaaaacgtaaggtaacggtttcgaaggggaccgacggggtaccaaccgagtacgaaccgaagggaaccaacgtaccaacgtacgacgacaacgacgaccctaacgagtagggaacgtcggtacggacggacgaacgggacgtagaagacgttaccgacggtaaccggaccgtaaccgggtaccgtaaggttaacgtttaccggtacggttagggaccgggtaaggttaacgggacgttaaagggttaaagtttaaacggttaaggttttttaggggaaggttttacggggtttaacggtttaaccggggttaacgggg

SEQ ID NO: 355665 - DNA, 616 bp, Homo sapiens
  misc_feature: GZ8MTXP01D90PJ.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctggacaagggcttgagtggatgggatggatcaacctaacgaatggtagacaacaaaactatcgacaacagtaagtttccgaggggcgacgggtacaccgagtacggaaccgaaggggaacaaccggttaccaatccgaagaccaacaacggacccgttaacacgttagggaacgtcgtagaacggccgaaggaccgtaggtaaacggattaccgtaggaaaccggtaccgaaacggggtcccgttagttacgttaacgttggttggacggtaaggacggaacgtaagggtaattacggttaagtttttgggtaaggg

SEQ ID NO: 355666 - DNA, 569 bp, Homo sapiens
  misc_feature: GZ8MTXP01D1O8J.45.78.H01.1.454.CMB.2.raw
  modified_base (293)..(293): a, c, t, g, unknown or other
  misc_feature (293)..(293): n is a, c, g, or t
  modified_base (355)..(355): a, c, t, g, unknown or other
  misc_feature (355)..(355): n is a, c, g, or t
  modified_base (374)..(374): a, c, t, g, unknown or other
  misc_feature (374)..(374): n is a, c, g, or t
  modified_base (446)..(446): a, c, t, g, unknown or other
  misc_feature (446)..(446): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagagcctggggcctcgagtgaaggtctctgcaaggtcttcgtggatacacccttcaccggtctaactatatacacgtgggtcncgacgacggccccctaggacgaagggcttggaggtggagtgggatggactacaaaccctaanagtggtgacaacaaaactntcgacaagtaagtaagtttcgaacggggtcgaagggtacaccgatacggaaccgaagggaccaacgtccaanccagcacacgcctaacgagtggagcgtaggagcgaggttcaggacgtatcgtggaacgacaccgggtcgttgtatacgttgttgacgaaggagcgtagtagttacgttaagttttggtaaggg

SEQ ID NO: 355667 - DNA, 640 bp, Homo sapiens
  misc_feature: GZ8MTXP01CYIMM.45.78.H01.1.454.CMB.2.raw
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
  modified_base (495)..(495): a, c, t, g, unknown or other
  misc_feature (495)..(495): n is a, c, g, or t
  modified_base (635)..(635): a, c, t, g, unknown or other
  misc_feature (635)..(635): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaacctaacaatggtggacaacaaaactatgacaacagtaaagtttcgagggcagggtcaccatgaccgaggacacgtccatcagcacagcctaacagtggagctggaacgcgaggctagacgntcgngacgacgacggccgtagtatacgtgtgacggagagacgaaggtaattacggttagttttggagtttggttaagtcgggtaaacgttagtcggtacgtggtacggggaccgaagggaccgacgtactaccgtctccacgacgccctacccgaacgaaccggccctacgttcccggttcccttcccccgnggcccctacccgtccctaacccgaacgaccgccgaacccgttcgggaccggggaccaaccggcggcccggcccgtgggcctcggccgtacggacgaacggtaccttccgttcaccgtcgtcgcgttcggcggcggtcggngtcgg

SEQ ID NO: 355668 - DNA, 626 bp, Homo sapiens
  misc_feature: GZ8MTXP01AP1JQ.45.78.H01.1.454.CMB.2.raw
  modified_base (296)..(296): a, c, t, g, unknown or other
  misc_feature (296)..(296): n is a, c, g, or t
  modified_base (370)..(370): a, c, t, g, unknown or other
  misc_feature (370)..(370): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacactcacttgaattggttacaacagaggccaggccaatctaccaaggcncctaaatttataaggtttctaaccgggactcgtggggtcccagacagattcagcggcagtggtcaggcaactgntttcaactactagaaaattggtagggtggaggctaggaggtattggttggtagtttatttctgctagtgacgaaaggttacaacgtacgtgggaccgttaactaccgttttggacccgtaagggggaacccaaaggtccgttaaggggaaaacttaaccgaaaacggttaaaccgttggttacgggaccttcggaccttaccgttacttccttcggttcctttcgtaactttaccctttcccccggaacttaaccg

SEQ ID NO: 355669 - DNA, 490 bp, Homo sapiens
  misc_feature: GZ8MTXP01EY519.45.78.H01.1.454.CMB.2.raw
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (357)..(357): a, c, t, g, unknown or other
  misc_feature (357)..(357): n is a, c, g, or t
  modified_base (451)..(451): a, c, t, g, unknown or other
  misc_feature (451)..(451): n is a, c, g, or t
  modified_base (469)..(476): a, c, t, g, unknown or other
  misc_feature (469)..(476): n is a, c, g, or t
  modified_base (478)..(490): a, c, t, g, unknown or other
  misc_feature (478)..(490): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctcctgcaaggcttctggatacaccttcacggctactatatacacgtgggtgcgacacggcccctggacaagggcttggagtggatgggatggatacaaacctaanaagtggngaccaacaaactngacaaacagtaagttcgagggcagggtcacagcgacgaggacacgtcatcacgcacacgcctacgagtaggagtcggaggacggcgggtacggnggacgacggcgagagtgnnnnnnnngnnnnnnnnnnnnn

SEQ ID NO: 355670 - DNA, 735 bp, Homo sapiens
  misc_feature: GZ8MTXP01AHODK.45.78.H01.1.454.CMB.2.raw
  modified_base (188)..(188): a, c, t, g, unknown or other
  misc_feature (188)..(188): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaanaatggtgcacaaactatgcacagaagtttcagggcagggtcaccatgaccagggacacgtccatcagcacagcctacatggagctgagcgaggctgagatctgaccgacgacggtcctagttacttacgtggtggacggtaaggacggtacgtaaggtaaactttacggtttagtttttggggacgtttgggtttacgttcggggtaaacgggttagtcggggtaccgtttcgggacgggggacccgtaaacgggggacccgtaccgggttacccgtacccggttcctaccccgtaccgaaccgtcccccgttacccgaaacccggtaacccgggtccccgtaaccgttccccgggttccccttcccccgtacgggtaccccctaccccgttacccgtaacccgaaacgccgacccgtacccggttcgggaccgggggaccacggtcccgggcccggtcccggtcgggtcctccgggttccgtacggttaccgaaacggtacccttacgttccgttacgcgtccgccgttgcggcggcggttcgcgg

SEQ ID NO: 355671 - DNA, 524 bp, Homo sapiens
  misc_feature: GZ8MTXP01AVOUO.45.78.H01.1.454.CMB.2.raw
  modified_base (411)..(411): a, c, t, g, unknown or other
  misc_feature (411)..(411): n is a, c, g, or t
  modified_base (434)..(434): a, c, t, g, unknown or other
  misc_feature (434)..(434): n is a, c, g, or t
  modified_base (448)..(448): a, c, t, g, unknown or other
  misc_feature (448)..(448): n is a, c, g, or t
  modified_base (457)..(457): a, c, t, g, unknown or other
  misc_feature (457)..(457): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctggggcctcagtgaggtctcgtgcaaggctctggatacaccttcaccggctactatatacacgtgggtgcgacacggcccctggacaagggcttagagtggagtgggatggatcaacctaacaagtggtggacaacaaaactatgcaacgagtaacgtttgaggggcagggtcacgatgacgagggtacacgtcancagcactacgcctacgatcggancgtgacgcgagcgngaggatcgngaacgacgacggtccgagtagttacttggttcgcgaagaggcgagtagttagtaagtttggttaagg

SEQ ID NO: 355672 - DNA, 588 bp, Homo sapiens
  misc_feature: GZ8MTXP01DKMHM.45.78.H01.1.454.CMB.2.raw
  modified_base (412)..(412): a, c, t, g, unknown or other
  misc_feature (412)..(412): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctagacgacacggcctatattacgtgtgcgaggagcaaggtaattacgttagttttggagttggtttatcgggtaaacgtgtggacgtcggtcggggaccaagggccacggtcaccgtctccncacgtccaccaccgtacggccctacgtcccggtcccttccccgtgcccctacccgtcctaccgaacgccgccacccgtggtcggggaccacgacggccgccgtgggcttcgccgttggttaccgaacggtaccttaccgttccttacggctcgcgaggcggcggtaacgcgaacgg

SEQ ID NO: 355673 - DNA, 549 bp, Homo sapiens
  misc_feature: GZ8MTXP01BN738.45.78.H01.1.454.CMB.2.raw
  modified_base (464)..(464): a, c, t, g, unknown or other
  misc_feature (464)..(464): n is a, c, g, or t
  modified_base (529)..(529): a, c, t, g, unknown or other
  misc_feature (529)..(529): n is a, c, g, or t
  modified_base (538)..(538): a, c, t, g, unknown or other
  misc_feature (538)..(538): n is a, c, g, or t
  modified_base (548)..(548): a, c, t, g, unknown or other
  misc_feature (548)..(548): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtattactgtgcgagaggcaggaattacgtatttttgggagttggttatcggaacgggttatgggacgtcgtggggccaaggggccacggtcaccgtctcctcacgcctccaccacgggcccagtccgtcctcccctcggccaccctccctccaacgcnccgacctcgtcggggccacgcgccggcccgtgggctcgccgtgttcgaaggcttacttccttcgntcgcgtcgngcggcggcgng

SEQ ID NO: 355674 - DNA, 604 bp, Homo sapiens
  misc_feature: GZ8MTXP01BCVOS.45.78.H01.1.454.CMB.2.raw
  modified_base (454)..(454): a, c, t, g, unknown or other
  misc_feature (454)..(454): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtcatcagcacagcctacatggagctgagcgaggctgagatctgacgacacggccgtgtattactgtgcgagaggcaggaattacgtattttggagttggttatcgggtaacgtatgggacgtcggtggggaccgaagggaccacgggtcaccgtctccgtcacgcctaccaaccgacgggccctacgtccggttcccttcccccgngccctaccccgtcctaccgaacgcgccacccgtcggtcgggggaccacgtacggccggtcccgtggggctcggccgtcgggttccgaaacgggtccttaccgttccgttacgaactccgggtcgtcgtgggacgggtccgggcgtcgggg

SEQ ID NO: 355675 - DNA, 588 bp, Homo sapiens
  misc_feature: GZ8MTXP01DFEEU.45.78.H01.1.454.CMB.2.raw
  modified_base (410)..(410): a, c, t, g, unknown or other
  misc_feature (410)..(410): n is a, c, g, or t
  modified_base (412)..(412): a, c, t, g, unknown or other
  misc_feature (412)..(412): n is a, c, g, or t
  modified_base (438)..(438): a, c, t, g, unknown or other
  misc_feature (438)..(438): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcatccatctcctgcaggtctagtcaaagcctctatacgagggataggaaacactcacttgaattggttacaacagaggccaaggccaaatcctacaaggcgtaccttaaatttaagtaaaggtttctaaaccgggactcgtagggggtcccaaggacagattcagccgcagtcgggtcaggcactgatttcacactagaaaagttgtagggngnggatgagatgttaggtatttatctgnagtgcaaaggggtacactacgtacggccgtactacgtttggacccgaggggtaaccaaggccttaagggaaaactacgaaaacggtaacttaggttagggcttaggaccaacctaattactcgtttctacattccctttaaccccgtaac

SEQ ID NO: 355676 - DNA, 671 bp, Homo sapiens
  misc_feature: GZ8MTXP01DVCDH.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagtttcagggcagggtcaccatgaccaggacacgtccatcagcacagcctacatggagctgagcaggctgagatctgacgacacggcgtagtattactgtgcgagagcgaaggtaattacgtagttttggagttggttagttcggaacggttatggacgtcggtcggggaccaacgggacccgtacggtccacccgtctcccgtacgaccgtccctacccgaacccgaaaccgggtcccctaacgttcccgggtcccctttccccccgcgggtacccctacccccgtccttacccgaaacgaccgaccgaccccgttccggtacgggggaccaccgtaccggcccgggtccccgtcggggcctccggttcccgtacgggttaccgtaaacgggtacccttaaccgtttcccgacggtcgttccggccgtttccgcggacgggtccggggcgtaacgggg

SEQ ID NO: 355677 - DNA, 616 bp, Homo sapiens
  misc_feature: GZ8MTXP01CBYI2.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgtattttggagttggttattcggaacggttagtggacgtcgtgggggaccaaggggacccacgggtccaccgtctcctcacgccctaccacccgaaacggggccccacgtccggtcccttccccctcgggcccacccctcccgtcccaaacgcgaccacccgttcgcgggggaccacgaccggccggcccgtgggcctcggcccgtcgggttaccgtaaacgggccttaaccttcccgttaccgtaacgtccggccgttcgtcggcgggtccgggcgtccgggg

SEQ ID NO: 355678 - DNA, 547 bp, Homo sapiens
  misc_feature: GZ8MTXP01CX11E.45.78.H01.1.454.CMB.2.raw
  modified_base (392)..(392): a, c, t, g, unknown or other
  misc_feature (392)..(392): n is a, c, g, or t
  modified_base (394)..(394): a, c, t, g, unknown or other
  misc_feature (394)..(394): n is a, c, g, or t
  modified_base (396)..(396): a, c, t, g, unknown or other
  misc_feature (396)..(396): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatggagctgagcaggctgagatctgacgacacggccgtgtattactgtgcgagagcaggaattacgattttggagtgttatcggaacggtatggagtctggggacaagggacacggtcacgtctccncncncaccacgaacggaccactcgtcctcccctccgccaccctccctaccaacgacgaccaccgtccgtcgggacgacgacggccggccgtcggcgtcgcgtcggacgaacgtacttaccgttccttcgtaactcgcgtcgtgacggtcggcgtg

SEQ ID NO: 355679 - DNA, 598 bp, Homo sapiens
  misc_feature: GZ8MTXP01BBZK7.45.78.H01.1.454.CMB.2.raw
  modified_base (378)..(378): a, c, t, g, unknown or other
  misc_feature (378)..(378): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcgagtgaacggtctccgtgacaagggtcttcgtggactacaccttcaccggctactatatacacgtgggtgcgacgacggccccgtaggacgaagggcttaggagtggagtgggatggatacaacctaacagtggtagacaacaaaactancgacaacaaggtaacgttcggagggacacgggtacacgatacgaccgaggacacgtcatcgagcaacacgacctagacgtggactcgtagaacgcgaggtacgtagaacgtacttcgaggaacgaaccgttacgggtaccgttaggtacgttacgttggttcggacggtaaggaggtaacgtaagggtacgttaacgggtttggtttttaagggtaaggg

SEQ ID NO: 355680 - DNA, 763 bp, Homo sapiens
  misc_feature: GZ8MTXP01B0E0J.45.78.H01.1.454.CMB.2.raw
  modified_base (287)..(287): a, c, t, g, unknown or other
  misc_feature (287)..(287): n is a, c, g, or t
  modified_base (334)..(334): a, c, t, g, unknown or other
  misc_feature (334)..(334): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatggagctgagcgaggctgagntctgacgacacggccgtgtattactgtgcgagaggcaggattacgtnttttaggagtggttattcggtaacgggttagtcgggtacggtcgtagggggtacccgaaggggtacccgacggggtacctacccggtcttttaccccgcgacgtaccccttcccgaaacccgtaacgggggaccccctaagttaccccgggttccccttacccccccgttagggcccctacccccgttacccctacccgaaacgtaaccggcctaaccccgttcgggtaccggggggccaaaccgtccggggccccggggtccccggtcggggtccggttcccgggttccccgggttacggggttacccggaaacgggggtaccccgttttaaccccgttttccccggttcccggaaacggtccccgggttccgggtttcccggggtacgggggttaccggggtcccgggggttcgggttaacccgggg

SEQ ID NO: 355681 - DNA, 582 bp, Homo sapiens
  misc_feature: GZ8MTXP01EWJPC.45.78.H01.1.454.CMB.2.raw
  modified_base (227)..(227): a, c, t, g, unknown or other
  misc_feature (227)..(227): n is a, c, g, or t
  modified_base (289)..(289): a, c, t, g, unknown or other
  misc_feature (289)..(289): n is a, c, g, or t
  modified_base (431)..(431): a, c, t, g, unknown or other
  misc_feature (431)..(431): n is a, c, g, or t
  modified_base (538)..(538): a, c, t, g, unknown or other
  misc_feature (538)..(538): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctnagtgaaggtctcctgcaggtcttctggatacaccttcaccggctactatatacacgtgggtncgacacggcccctggacaagggcttggagtgggagtgggatggataccaaacctaaccaagtggtagacaacaaaaactatcgacaacgagtaagtttccgaggggcgacgggtcaacgatacgaccgagggacacgtctanacagcacgagccttacgagtgggagcgtagacggacgaggacgtcggagtacgtcgtaacggaacgaacgaccgggtaccgttggttaattacgttggttcggacgnggagggcgtaaggttaagttacggttaagtttttaaggtaaggg

SEQ ID NO: 355682 - DNA, 687 bp, Homo sapiens
  misc_feature: GZ8MTXP01A8F4E.45.78.H01.1.454.CMB.2.raw
  modified_base (291)..(291): a, c, t, g, unknown or other
  misc_feature (291)..(291): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagaagtttcagggcagggtcaccatgaccagggacacgtccatcagcacagcctacatggagctgagcaggctgagatcngacgacacggccgtgtattactgtgcgagaggcaggaattacgtagttttggagttggttattcgggaacgttagtgggtacgtcggtggggtaccgaaggggtacccgacggtccacccgttcctacccgtcacgcccctaacccgacccgaaaccgggtcccacggttcccggttccccttcccccggcggtaccccctaccccggttccctaaccccgaaagacccgtaccctacccgtccgggtccggggaaccctaccgtccggggccccggtcccggtacgggccctccggttcccggtacggttaccgaaaccgggttccttaaccccgttccttccgggtaaccttccgggtccgttcgtcgggacgggtcccgggcgttaaccgggg

SEQ ID NO: 355683 - DNA, 534 bp, Homo sapiens
  misc_feature: GZ8MTXP01A2O3V.45.78.H01.1.454.CMB.2.raw
  modified_base (248)..(248): a, c, t, g, unknown or other
  misc_feature (248)..(248): n is a, c, g, or t
  modified_base (265)..(265): a, c, t, g, unknown or other
  misc_feature (265)..(265): n is a, c, g, or t
  modified_base (330)..(330): a, c, t, g, unknown or other
  misc_feature (330)..(330): n is a, c, g, or t
tcagacgcgatcgacacgaccggtgctcgatttagtgtgagtagtttgggtttgggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagagtattagtactggtgctgtatnagcagaaacaggaaacnccctaagctctgctctatagcatctagttagaagtgggtccatcaaggtcagcggcagtgatcgnggaacagaattcactctcaccatcagcagcctgcagctagattgtatttcgaacttaacttattactcggaacctaaagtagtatagtaattagttagttacgtacgttacggaccgtaaacgggaacgaaagggtagaaaactacgaaacgtaacgtggttacggcttcgaacacctaattctgttccttcttaacgttcccc

SEQ ID NO: 355684 - DNA, 666 bp, Homo sapiens
  misc_feature: GZ8MTXP01CY993.45.78.H01.1.454.CMB.2.raw
  modified_base (197)..(197): a, c, t, g, unknown or other
  misc_feature (197)..(197): n is a, c, g, or t
  modified_base (284)..(284): a, c, t, g, unknown or other
  misc_feature (284)..(284): n is a, c, g, or t
tcagacgcgatcgacacgaccggtgctcgatttagtgtgagtagtttgggtttgggggtcagacccagtcaggacacagcatggacatgagggtccccgctcagctcctggggctcctgctgctctggctcccaggtgccaaatgtgacatccagatcgacccagtcctccttccaccctgtctgcatctgtagganacagagtcaccatcacgttcggccgggaccagtcagagtattagtaactgggttcgcctggtatcagacaagaaaccgagggaaacnccctaagctcctgctactataacggcatacgttaagttaaggaacggtcggggtacccagtacgtaaggttcagcggcaggtggatcgtaggaaacagtaattcgaactcctacaccatacagtcagcctgcagtcagtactagttactttagacttaactttacttaacctacgggtaaccctaaagtaggttaactagtaacgtttacggtttaacttacccgggtaacggtttcccgggaaaccgtaaacgggggaaccgtaaaagggtaacggttaaaagttaaccgaaaacggttaaaccgtgggttacggccgttaccggaaccaaccgttaactttaccggttcgtttaactttaaccttaaccggttttccccg

SEQ ID NO: 355685 - DNA, 537 bp, Homo sapiens
  misc_feature: GZ8MTXP01DPL2X.45.78.H01.1.454.CMB.2.raw
  modified_base (293)..(293): a, c, t, g, unknown or other
  misc_feature (293)..(293): n is a, c, g, or t
  modified_base (339)..(339): a, c, t, g, unknown or other
  misc_feature (339)..(339): n is a, c, g, or t
  modified_base (447)..(447): a, c, t, g, unknown or other
  misc_feature (447)..(447): n is a, c, g, or t
  modified_base (491)..(491): a, c, t, g, unknown or other
  misc_feature (491)..(491): n is a, c, g, or t
  modified_base (505)..(505): a, c, t, g, unknown or other
  misc_feature (505)..(505): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggtcttctggatacaccttcacggctactatatacactggtgcgacncggcccctggacaaggcttgagtggatgggatggatcaaccctaanaagtggtagacaacaaaaactatgacacgaaggtaagtttcgaggggcagggtcacgatcgacgagggacacgtaccatcagacacagccctagatggagctgagcgnggctgagactcgtaggaactaacgacggtcttaggtacttacgngttcgagaagacgngtaaggtagtttacgttaagttttgggtaagg

SEQ ID NO: 355686 - DNA, 541 bp, Homo sapiens
  misc_feature: GZ8MTXP01ANN2J.45.78.H01.1.454.CMB.2.raw
  modified_base (225)..(225): a, c, t, g, unknown or other
  misc_feature (225)..(225): n is a, c, g, or t
  modified_base (286)..(286): a, c, t, g, unknown or other
  misc_feature (286)..(286): n is a, c, g, or t
  modified_base (389)..(389): a, c, t, g, unknown or other
  misc_feature (389)..(389): n is a, c, g, or t
  modified_base (443)..(443): a, c, t, g, unknown or other
  misc_feature (443)..(443): n is a, c, g, or t
  modified_base (452)..(452): a, c, t, g, unknown or other
  misc_feature (452)..(452): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctnagtgaaggtctcctgcaaggcttctggatacaccttcaccggctactatatacactgggtncgacaggcccctggacagggcttgagtgggatgggatggatcaacctaacaagtggtggacacaaaactatgacacgagtaagtttcgagggcagggtcacangaccagggacacgtcagtcagcacgagacctagatggagcgtgaagcgaggtcngagactcgngaacgaccgacgggtacccgttgtaaagttcgttgttcgaccggaaggaggtccgaagggtaattacggttaagtttttggggtaaggg

SEQ ID NO: 355687 - DNA, 548 bp, Homo sapiens
  misc_feature: GZ8MTXP01A4GHT.45.78.H01.1.454.CMB.2.raw
  modified_base (228)..(228): a, c, t, g, unknown or other
  misc_feature (228)..(228): n is a, c, g, or t
  modified_base (289)..(289): a, c, t, g, unknown or other
  misc_feature (289)..(289): n is a, c, g, or t
  modified_base (442)..(442): a, c, t, g, unknown or other
  misc_feature (442)..(442): n is a, c, g, or t
  modified_base (466)..(466): a, c, t, g, unknown or other
  misc_feature (466)..(466): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctnagtgaaggtctcctgcaaggcttctggatacaccttcaccggctactatatacactgggtncgacacggcccctggacaagggcttggagtggagtgggatggactacaaacctaacaagtggtcgacaactaaaaactagtgacaacgagtaagtttcgagggcagggtcacgatagacgaggacacgtcatcagcacacgctacgagtggancgtagagcgaggctgagtagtcgngaacgacgacgggtccgttgtaaacttcgttgttggacggaaggacggaacgtaaggtaacgtttagttgttttgggtaagg

SEQ ID NO: 355688 - DNA, 639 bp, Homo sapiens
  misc_feature: GZ8MTXP01B4GS3.45.78.H01.1.454.CMB.2.raw
  modified_base (225)..(225): a, c, t, g, unknown or other
  misc_feature (225)..(225): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagcgtgggcctnagtgagtctctgcaggtcttgtggatacaccttcgaccggctactatatacacgtgggtgccgacgacggccccgtaggacgaagggtcttggagtgggagtcgggatggactacaaacctaacaagtggtagaccaacaaaacttatcgacaaacgagtaacgtttcgaggggtacaagggttaccaacgtacgtacgaaccggaacggggaaccaaccggtaccataccgaacgaccaacgacgaccctaacgtaacgtggggaacgtccgtaggaacgtccggaaggcgtaaggacggttacacgtcggaaccggtacgttaccgggtccgttagttacgtaacgttcggcggacgggaaggacggtaaccgtaaacgggtagtttaccgggttaagtttttggtaagggg

SEQ ID NO: 355689 - DNA, 544 bp, Homo sapiens
  misc_feature: GZ8MTXP01CHWMC.45.78.H01.1.454.CMB.2.raw
  modified_base (286)..(286): a, c, t, g, unknown or other
  misc_feature (286)..(286): n is a, c, g, or t
  modified_base (513)..(513): a, c, t, g, unknown or other
  misc_feature (513)..(513): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaaggcttctggatacaccttcaccggctactatatacactgggtncgacacggcccctggacaagggcttggagtggatgggatggatcaaccctaacgatggtcggacaacaaaaactatgacaacgagtaagtttcaggggtcacggggtacacgatacgaccgagggacacgtaccatcagcacagacctacgagtggagctgagcgaggctagagatcgtgaacgacgacgggtccgttaggtacttacgttggttgcggaagacggngaaggtaacttaggttaagttttgggtaagg

SEQ ID NO: 355690 - DNA, 585 bp, Homo sapiens
  misc_feature: GZ8MTXP01BW39Q.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcgagtgaaggtctcctgcaaggtcttcgtggatactaccttcaccggctactatatacacgtggtgcgacgacggccccgtggacgaagggtcttggagtggagtgggatggactaccgaaaccctaaacaagtttttggaggacaacaaaaactatgacaacgagtaagttacgagggacgagggtacacgagtacgacgaggacacgtcatcagacactacgcctaacgagtggacgtcgagacgacgacggacgagaacggtacgtacgacgaacgacgaccgggtccgttagtaagttacgttgcgcggaaggacggtaacgaaggttaagttagttaaggttttgggtaaggg

SEQ ID NO: 355691 - DNA, 661 bp, Homo sapiens
  misc_feature: GZ8MTXP01BG8W9.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatggagctgagcaggctgagatctgacgacacggctgtattactggtcgacgaggaggcgaaggtaattacgtagtttttggagttggttagttcggaacggttagtgggacgtcgtacggggaccgaacggggacccaacgggtccaacccggttctcctaccgacggtccctaccgaacccgaaacgggtcccctacgtccgggttcccttcccccgtacggacccctaccccgtccgtacccgaacgaccgaccgacccgtccgtacgggggacccacgtacgggcccggtccccgtcggggcccttcggccgttacggttaccgtaaacggtaccttaccgttccgttaccgtaacgtccggaacgttcgtcggacggtcgggaacgtcggg

SEQ ID NO: 355692 - DNA, 521 bp, Homo sapiens
  misc_feature: GZ8MTXP01BF751.45.78.H01.1.454.CMB.2.raw
  modified_base (462)..(462): a, c, t, g, unknown or other
  misc_feature (462)..(462): n is a, c, g, or t
  modified_base (486)..(486): a, c, t, g, unknown or other
  misc_feature (486)..(486): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctcagtgaggtctctgcaaggcttctggatacaccttcaccggctactatatacacgtgggtgcgacacggcccctggacaagggcttggagtggatgggatggatcgaaaccctaacaagtggtaggcaacaaaaactatggacacagtaagtttcgaggggcagggtcacatcgacgaggacacgtccatcagcacagacctacgagtggacgcgtgacgcgaggcgtgaagctcgngaacgcgacggtcgttgtacgtanggttgcggaagngngaggattagtgttttaaggtg

SEQ ID NO: 355693 - DNA, 546 bp, Homo sapiens
  misc_feature: GZ8MTXP01BJMIR.45.78.H01.1.454.CMB.2.raw
  modified_base (423)..(423): a, c, t, g, unknown or other
  misc_feature (423)..(423): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctgagtgaaggtctcctgcaaggcttctggatacaccttcaccggctactatatacacgtgggtgcgacacggcccctggacaagggcttgagtggagtgggatggatacaacctaacaagtggtggacacaaaaactatgcacgagaagtttcgagggcagggtcacgatagaccgagggacacgtcatcagcacanacctagagtggagcgtagagcgaggcgtaggagatcgtggaacgacgacgggtccgttgtaacgttcgttagttcggacggtaagacggaagtaaggtacgttaggttaagttttgggtaagg

SEQ ID NO: 355694 - DNA, 602 bp, Homo sapiens
  misc_feature: GZ8MTXP01BPHE8.45.78.H01.1.454.CMB.2.raw
  modified_base (285)..(285): a, c, t, g, unknown or other
  misc_feature (285)..(285): n is a, c, g, or t
  modified_base (560)..(560): a, c, t, g, unknown or other
  misc_feature (560)..(560): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtgggcctcagtgaagtctctgcaagctctggatacacttcacggctactatatacactggtgcgacncggcccctggacaaggctgagtgagtgggatggataccaaaccctaagaatggcgacaacgtaaaaactatgacaacaagtaacgtttcgaaggggcgtacggggtaccaaccgagtacggaacccgaaggggaacctaaccggttccaaacgtccgaacggaccaaaccaacggacccttaaacgaggttcgggaacgtccgagaaccggcgtaaggctagaagatctacgggaacgaacgcgggtccgttagttaacgttccgttaggttcgnggaaggngngtaaagggtatttagggttaattttggggtaag

SEQ ID NO: 355695 - DNA, 672 bp, Homo sapiens
  misc_feature: GZ8MTXP01D6TF7.45.78.H01.1.454.CMB.2.raw
  modified_base (292)..(292): a, c, t, g, unknown or other
  misc_feature (292)..(292): n is a, c, g, or t
  modified_base (387)..(387): a, c, t, g, unknown or other
  misc_feature (387)..(387): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagccgtgggcctgagtgagtctctgacgaggtcttgtggactacgaccttcgaccggtctactatactacacgtgggtnacgacgacggtccccgtaggaaccgtaagggtcttaggaggtggagtgggataggactaccgaaacctaagagtgggtacgacaactaaaaactntcgacaaacgtaaggtaacgttacggaggggtacgtacgggtaccaacgtagtacgaaccgagggaacctacgtcagtacgagacctacgaacgtaccctaagacgttgggaacgtcgtacggacggcggtaagggtacgtagtaaagtacgttaccggaggaaacccgtaacgggttcccgggtaccgttacgttaagtttaacggttgggttcggaccgggtaagggaccggtaagtaagggttaaacgtttagggttttaaaggttttcggggttttaaggg

SEQ ID NO: 355696 - DNA, 546 bp, Homo sapiens
  misc_feature: GZ8MTXP01EPLWU.45.78.H01.1.454.CMB.2.raw
  modified_base (197)..(197): a, c, t, g, unknown or other
  misc_feature (197)..(197): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (374)..(374): a, c, t, g, unknown or other
  misc_feature (374)..(374): n is a, c, g, or t
  modified_base (532)..(532): a, c, t, g, unknown or other
  misc_feature (532)..(532): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccgggccagtcagagtattagtaactggtgctgatnagcagaacaggaaacnccctaagctctgctactataaggctatactaaggtttagaaagttcggggtaccatcaaggttcagcggactagtggatcgtagggacaagaattcactctacacntcagcagcctgcagtcctagatgtatttcgactaacttattacgtcgacctaagtagtatagtattagttactacggtacgttacggaccgaaagggtaaccgtaaagggttaggaaattacgaaacgtaacgttgttcgctaagctaacattcgttntaaccttcgtaacc

SEQ ID NO: 355697 - DNA, 672 bp, Homo sapiens
  misc_feature: GZ8MTXP01B0OSK.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtatactgtgcgagagcaggtaattacgtattttgggagttggttaattcgggaaacggttatcgggtacgtcgtacgggggaccaaggggtacccaacgggtcccaccggtcctacctcgacgaccctcccgaacccgaacggggtccccaacgttcccggtcccttccccccgaggtccccaccccgttccctacccgaaaggccgacctacccgtccggtacgggggaccaaccgtacgggcccggcccggtcggggtcccgtcggcccggttcgggttaccgtaaacgggtacccttaacccgttcccgttacggaacgttcccggcggttcccgggcgggttacgggtccgggttcggtcgg

SEQ ID NO: 355698 - DNA, 561 bp, Homo sapiens
  misc_feature: GZ8MTXP01EE41M.45.78.H01.1.454.CMB.2.raw
  modified_base (535)..(535): a, c, t, g, unknown or other
  misc_feature (535)..(535): n is a, c, g, or t
  modified_base (560)..(560): a, c, t, g, unknown or other
  misc_feature (560)..(560): n is a, c, g, or t
tcagacgcgatcgacacgaccggtgctcgatttagtgtgagtagtttgggtttggggtgaagaagcctggggcctcagtgaaggtctcctgcaaggcttctggatataccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtatactgtgcgagagcaggaattacgtattttggagtggttatcggaacgtatggacgtcgtggggaccaaggggaccacgggtcaccgtctcctcacgcctccaccgaacgggcccagtccggtcccttccccgtggcccaccccggtcctccgaagacgcacccgtcgtcgggggccacgcggccggcccgtgggcctgcccgtggttccgaaggtacttacgttccncgaactcgcgtctggcgcggttcgng

SEQ ID NO: 355699 - DNA, 637 bp, Homo sapiens
  misc_feature: GZ8MTXP01C2OFD.45.78.H01.1.454.CMB.2.raw
  modified_base (401)..(401): a, c, t, g, unknown or other
  misc_feature (401)..(401): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagagcaggattacgtattttggagttggttattcggaacggttatgggacgtcgtggggaccaagggaccacgggtcaccgtcncctcacgcctccaaccgtacgggcccacgtccggtcctcccccgtggccctacccctccctaccccgaaacgtacgccctaacccgtcgttacggggggacccaccgtacggtccccgggccccgttcggggcccgttcggaccccggttgggttacccgtaaacggggtcccttaaccgtttcccgttacgtaaccgtccggccggttaccgtggacgggccggggttcgtcggg

SEQ ID NO: 355700 - DNA, 572 bp, Homo sapiens
  misc_feature: GZ8MTXP01A194T.45.78.H01.1.454.CMB.2.raw
  modified_base (469)..(469): a, c, t, g, unknown or other
  misc_feature (469)..(469): n is a, c, g, or t
  modified_base (499)..(499): a, c, t, g, unknown or other
  misc_feature (499)..(499): n is a, c, g, or t
  modified_base (507)..(507): a, c, t, g, unknown or other
  misc_feature (507)..(507): n is a, c, g, or t
tcagacgcgatcgacacgaccggtgctcgatttagtgtgagtagtttggggttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggtaattacgtattttggagttggttagttcgggtaacggtagtgggtacgtcgtagggggcccgtaaggggaccgtacgggtccacccggttctccctcacgccctcccaccgtaacgggcccacgtcggttcccttcccccgnggcccacccctcctccaacgcgccactcgnggggcacngccgccgtgggctgcctggttcgaacggcttacgttccttcgctcgcgtcgtgagtcgggctggg

SEQ ID NO: 355701 - DNA, 570 bp, Homo sapiens
  misc_feature: GZ8MTXP01C3ZR1.45.78.H01.1.454.CMB.2.raw
  modified_base (482)..(482): a, c, t, g, unknown or other
  misc_feature (482)..(482): n is a, c, g, or t
  modified_base (566)..(566): a, c, t, g, unknown or other
  misc_feature (566)..(566): n is a, c, g, or t
tcagacgcgatcgacacgaccggtgctcgatttagtgtgagtagtttggggttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcaacagtaagtttcgagggcagggtcaccatgaccagggacacgtccatcagcacagcctacatggagctggagcgaggcgtgaggatcgtagacgacgacggcgtgtactacgtgtgcgagagacagtattacgtagttttggagttggttagttcggaacgttagtggacgtcgtcggggaccaaggggccacgggtcaccgtctcctcgacgtcccaccgaaccgacgggccctacgtccgtcctccccgtgcccaccgtcccacgaagcncaccgtgcgggcacgcgccgcccgtggctcgccgtggacgaaacgtccttacgttccgcgtaacgtcgcgttcggcggcgcggngtcg

SEQ ID NO: 355702 - DNA, 609 bp, Homo sapiens
  misc_feature: GZ8MTXP01DGJZH.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggattacgtattttggagtggttatcggaacggtatgggacgtcgtggggaccaaggggaccacgggtcaccgtctcctcacgcctaccaccgaacgggcccacgtccggtccttcccccgtcggccacccgtccctaccaacgacgccaccctcgtcgggggccacgacgccggcccgttggggctcggccgttcggccgaaacgggtccttaccggtttcccttaccggtaacgttcccggccggtttcccggtcgggttaccgggtccgggttccggtcggg

SEQ ID NO: 355703 - DNA, 536 bp, Homo sapiens
  misc_feature: GZ8MTXP01BI7SE.45.78.H01.1.454.CMB.2.raw
  modified_base (448)..(448): a, c, t, g, unknown or other
  misc_feature (448)..(448): n is a, c, g, or t
  modified_base (505)..(505): a, c, t, g, unknown or other
  misc_feature (505)..(505): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccggctaactatatacacgtgggtgcgacacggcccctggacaagggcttggagtggagtgggatggactacaaacctaacagtggtggacaacgaaaactatcgacacgagtagtttcgagggcgagggtcacgagtacgacgaggacacgtcatcagcacacgcctacgagtggacgtcgngacgcgaggcgtagagactcgtagaacgcgacggcgttgtatacgttgttgcgaagnggcgtaaggtagttagtaagtttggtaaggg

SEQ ID NO: 355704 - DNA, 666 bp, Homo sapiens
  misc_feature: GZ8MTXP01D890O.45.78.H01.1.454.CMB.2.raw
  modified_base (218)..(218): a, c, t, g, unknown or other
  misc_feature (218)..(218): n is a, c, g, or t
  modified_base (240)..(240): a, c, t, g, unknown or other
  misc_feature (240)..(240): n is a, c, g, or t
  modified_base (584)..(584): a, c, t, g, unknown or other
  misc_feature (584)..(584): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagcgtgggcctnagtgagtctcctgcaggcttcnggactacaccttcacggctactatatacacgtgggtcgcgacgcggcccctaggacaagggtcttggaggtggagtgggatggaactaccaaaccctaacaagtgggtacgaccaaacgtaaaactatacgacgaaaacgtaaggtaacggtttcgaaacgggggtaccgaacgggggtacccaaaccgtacgttacgggaacccgaaggggaaccctaccggtaccctaataccgaacggccaaccgaacgaccccttaacgagttagggacgcggtaggacgaccgaagggctaggaagtatacgtacgaacgacgtaccgggtccgtaagttacgttacgnggttacggacgaaggacggttagttaaggtaagtttaggttaagttttggggaggttacgggtttaaggttcgggttaaggg

SEQ ID NO: 355705 - DNA, 636 bp, Homo sapiens
  misc_feature: GZ8MTXP01DKX2J.45.78.H01.1.454.CMB.2.raw
  modified_base (249)..(249): a, c, t, g, unknown or other
  misc_feature (249)..(249): n is a, c, g, or t
  modified_base (288)..(288): a, c, t, g, unknown or other
  misc_feature (288)..(288): n is a, c, g, or t
  modified_base (405)..(405): a, c, t, g, unknown or other
  misc_feature (405)..(405): n is a, c, g, or t
  modified_base (410)..(410): a, c, t, g, unknown or other
  misc_feature (410)..(410): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctctatacagggataggaaacnctcacttgaattggttacaacagaggccaggaccaatcnccaaggcgaccttaaatttattaaggttctaaaccgggactcgtcggggtacccagacagattcagcggcaggtggcaggctaactgtaatttcaactactagaaaattggtagggnggagngtgaggatgttggtagtttattcgtgctagtgacgtaaacggtacaacgtacgttcgggtacccgttacgttaacgttttcgggacccggtaaacgggggtaaccctaaggaccgttaaaggggaaaacttaacgaaaaaccggttaacgtggttacgggtactacggaccgttaccttaacttcgtacgtttccttactacttcccgttccccgaaccgttaacg

SEQ ID NO: 355706 - DNA, 597 bp, Homo sapiens
  misc_feature: GZ8MTXP01CPVMP.45.78.H01.1.454.CMB.2.raw
  modified_base (344)..(344): a, c, t, g, unknown or other
  misc_feature (344)..(344): n is a, c, g, or t
  modified_base (375)..(375): a, c, t, g, unknown or other
  misc_feature (375)..(375): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtggagctggtgcagtcgtggggctgaggtgaagagcgtggggcctcagtgaagtctctgcaaggcttctggatacaccttcaccggctactatatacacgtgggtgcgacacggcccctggacgaagggcttggagtggagtgggatggactaccaaacctaanaacgtgggtagacaaacaaactaatagcaanagtaagtttcgaggggacagggtaccacgtagtacggacgagggaccacgtaccatcacgcaacacgacctacgacggtagggacgtccgtaggacgacgaggcgtaggaagtacgtcgtacgaaccgaaccgtacgggttcccgtagttacgttacgtggttacggcggacggaaggacgtaaggtaagtttacggttagtttttcgggaaggtttaaggg

SEQ ID NO: 355707 - DNA, 592 bp, Homo sapiens
  misc_feature: GZ8MTXP01A66A9.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcgagtgaaggtctctgcaaggcttctggatacaccttcgaccggctactatatacacgtgggtgcgacgacggcccctggacgaagggcttggaggtggagtgggatggactacgaaacctaacaagtggagacaacaaaactatgacacgaagtagtttcgagggacgtacgggtcacgtagacgaaccgacgggacacgtcagtacgaacgacaacgacgaccctaacggacgtagggaacgcgtagacggaccgaggctaggacgtatccgtaggaacgacggaccggtccggttagtacgttacgttggttggacggaaggacggtaagaagggtagttacggttaagttttgggtaaggg

SEQ ID NO: 355708 - DNA, 562 bp, Homo sapiens
  misc_feature: GZ8MTXP01AGFOB.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagctgagatctgacgacacggccgtgtattactgtgcgagaggcaggaattacgattttggagtggttatcggaacggttatggacgtcgtggggccaaggggaccacgggtcaccgtctcctcacgcctccaccgaacgggcccagtcggtccttcccctggccaccctcctccaacgacgccaccgtctcgggggccacgacgccggcccgtgggcctcggccctcgggttcgaaacggcttacgttcccttcgaactcgcgtcgtcggcggtcggcgtgg

SEQ ID NO: 355709 - DNA, 544 bp, Homo sapiens
  misc_feature: GZ8MTXP01AQTK9.45.78.H01.1.454.CMB.2.raw
  modified_base (290)..(290): a, c, t, g, unknown or other
  misc_feature (290)..(290): n is a, c, g, or t
  modified_base (313)..(313): a, c, t, g, unknown or other
  misc_feature (313)..(313): n is a, c, g, or t
  modified_base (394)..(394): a, c, t, g, unknown or other
  misc_feature (394)..(394): n is a, c, g, or t
  modified_base (398)..(398): a, c, t, g, unknown or other
  misc_feature (398)..(398): n is a, c, g, or t
  modified_base (437)..(437): a, c, t, g, unknown or other
  misc_feature (437)..(437): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcgagggcagggtcaccatgaccagggacacgtccatcagcacagcctacatggagctgagcgagcgcgaganctagacgacacgctgtatcgtgngcgagagcaggtatagtacgtttgagtggtattcggaagtagtggacgtcgtgggacgaacgggcacgtcaccgtctcccncgcnccgccacgacgccgtccgtccgtccgtcccgtccgcccncccgtacctaccgacgaccgccgccgtcggcggcgacgtcgccgccgcggcgtcgcgtcggcgtacgtacttccgttcttcgcgtcgtcgtcgtcggcgcggcgtcg

SEQ ID NO: 355710 - DNA, 556 bp, Homo sapiens
  misc_feature: GZ8MTXP01EUOJV.45.78.H01.1.454.CMB.2.raw
  modified_base (228)..(228): a, c, t, g, unknown or other
  misc_feature (228)..(228): n is a, c, g, or t
  modified_base (525)..(525): a, c, t, g, unknown or other
  misc_feature (525)..(525): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctnagtgaaggtctcctgcaagggcttctggatacaccttcaccggctactatatacacgtgggtgcgacgacggccccctggacgaagggtcttgagtggagtgggatggactacaacctaacaagtggtaggacaactaaaactatcgacacgagtaagtttcgaggggctagggtcacgatacgacgaggacacgtcatcacgcacagacctacgagtggacgcgtgacgcgaggacgtgagagtcgagaacgtacgacggtccggttagtagtacgttggttgacggaaggacggngaagggtattaggtaagtttttgggtaaggg

SEQ ID NO: 355711 - DNA, 640 bp, Homo sapiens
  misc_feature: GZ8MTXP01ANREF.45.78.H01.1.454.CMB.2.raw
  modified_base (254)..(254): a, c, t, g, unknown or other
  misc_feature (254)..(254): n is a, c, g, or t
  modified_base (584)..(584): a, c, t, g, unknown or other
  misc_feature (584)..(584): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagaagccgtggggcctcgagtgaaggtctctgacaaggcttcnggatacaccttcaccggctactatatacacgtgggtcgcgacgacggccccgtggaaccgaaggggtcttaggaggtgggagttagggggatgggaactaccgaaacccctaaacgaagttgggtacggacaaccaaaaacttgcgacaacaaggtaacgtttcgacggggcagggtaccaacgagtacgaaccgagggaccaccggtaccagtcaacgccaacgacgaccctagacgtggaacgtccgtaggacgtcggaccggtcgtaggacttacgtcggtaaccgaaccggacgttaccgggggtaccttagggtaacttacgggngttcggacggaaggaggtaacgaaggttaacgttacggttaagttttcggggtaag

SEQ ID NO: 355712 - DNA, 637 bp, Homo sapiens
  misc_feature: GZ8MTXP01ADHUQ.45.78.H01.1.454.CMB.2.raw
  modified_base (289)..(289): a, c, t, g, unknown or other
  misc_feature (289)..(289): n is a, c, g, or t
  modified_base (600)..(600): a, c, t, g, unknown or other
  misc_feature (600)..(600): n is a, c, g, or t
  modified_base (608)..(608): a, c, t, g, unknown or other
  misc_feature (608)..(608): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcgagggcagggtcaccatgaccagggacacgtccatcagcacagcctacatggagctgagcgagcgtgagntctgaccgacaccggtacgtgtacttacgtggtgcggtaggaggacgaaggtaaatttacgttacgtttttgggagtttggttagttcgggtaaacgggttagtcgggacgtcggtcggggacccgaacggggaccacgggtccaccgtctccgtcgacgtccctccgaaccgaacgggcccctacgttcccggttccttcccccgcggccctaccccggttcccacgaacgacgcctaccgcgtacgggggaccacgtccggccgtcccgtgggcctcgccgtagttccgaacggtaccttaccgttccncggtaacncgtccgttcgaggttcggtcggcgaacgg

SEQ ID NO: 355713 - DNA, 587 bp, Homo sapiens
  misc_feature: GZ8MTXP01DSTMT.45.78.H01.1.454.CMB.2.raw
  modified_base (295)..(295): a, c, t, g, unknown or other
  misc_feature (295)..(295): n is a, c, g, or t
  modified_base (355)..(355): a, c, t, g, unknown or other
  misc_feature (355)..(355): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
  modified_base (416)..(416): a, c, t, g, unknown or other
  misc_feature (416)..(416): n is a, c, g, or t
  modified_base (422)..(422): a, c, t, g, unknown or other
  misc_feature (422)..(422): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctgagtgaaggtctccgtgcaaggtcttcgtggactacaccttcgaccggctactatatacacgtgggtncgacacggcccctaggacgaaggcttagagtggagtgggatggatacaacctaagatggngacacgaaaactntgcaanagtagttcgagggcagggtcacagtcgacgaggacacgtcancagcanacgacctagagtgctcgagagcgagtcgtgagtacgtcgtacggaacgtaacgaccgggtccgttaggtaaacgtttccggttacggttaggacccggtaaggggaaggtaacccgtaaaggggttaaccgtttaggtttaacggtttttggggttaaacggggg

SEQ ID NO: 355714 - DNA, 550 bp, Homo sapiens
  misc_feature: GZ8MTXP01BILPK.45.78.H01.1.454.CMB.2.raw
  modified_base (435)..(435): a, c, t, g, unknown or other
  misc_feature (435)..(435): n is a, c, g, or t
  modified_base (520)..(520): a, c, t, g, unknown or other
  misc_feature (520)..(520): n is a, c, g, or t
  modified_base (527)..(527): a, c, t, g, unknown or other
  misc_feature (527)..(527): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggcttctggatacaccttcaccggctactatatacacgtgggtgcgacaggcccctggacgaagggcttaggaggtggagtggggatgggactacgaaaccctaacaagtggtaggacaacaaaaactatgacaacgagtaagtttcgaggggcagggtcaacgatacgaccgagggaccacgtacacncacgcacacgccctagagtggagcgtgaagcgaggcgtgacgatcgagaaccgacgacgggtcgttgtagtacgttggttgacgngacggtnaaggtattagtgttttggtaagg

SEQ ID NO: 355715 - DNA, 585 bp, Homo sapiens
  misc_feature: GZ8MTXP01BDUDK.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagccgtgggcctgagtgaggtctcctgcaaggcttctggatacaccttcaccggctactatatacacgtgggtgcgacgacggccccgtggacgaagggcttaggaggtgggagtgggataggactaccgaaaccctaacgagtggtacggacaacaaaactatgacacgagtaagtttcgagggcgagggtccacgagtacgacgaggacacgtcatacagacacacgacctacgagtaggagcgtaggacgcgaggcgtagacgacgttcgacggaacgacgttacgggtccgttaggtaacgttacgttggttcggacggaaggacggtaagtaagggtaagtttacggttaaggtttttgggtaaggg

SEQ ID NO: 355716 - DNA, 493 bp, Homo sapiens
  misc_feature: GZ8MTXP01BX5SX.45.78.H01.1.454.CMB.2.raw
  modified_base (136)..(136): a, c, t, g, unknown or other
  misc_feature (136)..(136): n is a, c, g, or t
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
  modified_base (270)..(270): a, c, t, g, unknown or other
  misc_feature (270)..(270): n is a, c, g, or t
  modified_base (309)..(309): a, c, t, g, unknown or other
  misc_feature (309)..(309): n is a, c, g, or t
  modified_base (318)..(318): a, c, t, g, unknown or other
  misc_feature (318)..(318): n is a, c, g, or t
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
  modified_base (391)..(391): a, c, t, g, unknown or other
  misc_feature (391)..(391): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (399)..(399): a, c, t, g, unknown or other
  misc_feature (399)..(399): n is a, c, g, or t
  modified_base (401)..(401): a, c, t, g, unknown or other
  misc_feature (401)..(401): n is a, c, g, or t
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
  modified_base (443)..(443): a, c, t, g, unknown or other
  misc_feature (443)..(443): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctnttcttggtggcagcagccacaggagcccactcccaggtgcagctggtgcagtcgtggggctggaggtgaagagcgtgggcctgagtgagtctcngcagtctngatacnctcaccgntactananacacgtgggncgagcggcccctggacagggcttgagtggatggatggancaaacctanagtgngacanaaatngacaaanagtaagttcgaggcaggtcacatcgacaggtnacgcaancancanctacanagngangngngagagngngagagtacgacgacgacgacgcgtgtagttgtgngagagagagagtaagttagttaagttggtaggttagttaagttggtaagg

SEQ ID NO: 355717 - DNA, 650 bp, Homo sapiens
  misc_feature: GZ8MTXP01APH85.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagagccgtggggcctcgagtgaggtctctgcaaggcttcgtggatactaccttcgaccggctactatatacacgtgggtgcgacgacggcccctaggaacgagggtcttggaggtggagtgggatggactacaaacctaacgagtggtagacaactaaaaactatcgacaacgaagtaacgtttacggacggggacgtacggggtaccaaccgtagtacggaaccggaacgggaccgaaccggtaccaacgtaccgaacgaccaacgacgaccccgttaagacggtacggggacgtacgtacggacggacggacgggaccgtaggtaacggtacgttaccgaacggtaaccggaacggttaccgggtccgttagttacgttacgttggttcgacggaaggaggaacgtaaggtagttacgttaaggtttggtaaggg

SEQ ID NO: 355718 - DNA, 564 bp, Homo sapiens
  misc_feature: GZ8MTXP01ANZZA.45.78.H01.1.454.CMB.2.raw
  modified_base (225)..(225): a, c, t, g, unknown or other
  misc_feature (225)..(225): n is a, c, g, or t
  modified_base (351)..(351): a, c, t, g, unknown or other
  misc_feature (351)..(351): n is a, c, g, or t
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagcctggggcctnagtgaaggtctcctgcaaggcttctggatacaccttcaccggctactatatacacgtgggtgcgacacggcccctggacgaagggcttggagtgggagtgggattggatacaaccgtaacagtggnggacaacaaaactatcgacaacgaaggtaacgtttcgaggggcgagggtcaaccgatagaacgaggacacgtaccatcagcaacacgcctagagtggacgcgtagagcgaggcgtgagtacgtcgtgaaccgacgaccgggtccgttagtacttacgttggttgaccggaaggaggaacgtaagggtaagttacgttaagttttgggtaaggg

SEQ ID NO: 355719 - DNA, 665 bp, Homo sapiens
  misc_feature: GZ8MTXP01EESGT.45.78.H01.1.454.CMB.2.raw
  modified_base (244)..(244): a, c, t, g, unknown or other
  misc_feature (244)..(244): n is a, c, g, or t
  modified_base (339)..(339): a, c, t, g, unknown or other
  misc_feature (339)..(339): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagaagcgtggggcctgagtgagtctctgcagctntgatacaccttcacgctactatatacagtgggtgcgacgcggcccctagggacgaagggtcttggagtggagtgggatggataccaaaccctaanaagtggtacgacaaacgaaaactagtcgacaacgaagtaagtttcggaggggacgtagggtaccaaccgtagacggaccgaacgggactaaccggttaccaacgtcgaacgaccaacgtacgaccccgttaacggaaggtacggggacgtcgaggaacgggccgaaagggtcgtaggaacgtacgttacggcggaaacccggacggttaaacccgggtcggttaagttaacgtttaaccgttgggttcgggaacgggtaagggaaccggaacggttaaacggggtttaaacgttacgggtttttaaggggtttttgggttaagggg

SEQ ID NO: 355720 - DNA, 549 bp, Homo sapiens
  misc_feature: GZ8MTXP01C1WQO.45.78.H01.1.454.CMB.2.raw
  modified_base (252)..(252): a, c, t, g, unknown or other
  misc_feature (252)..(252): n is a, c, g, or t
  modified_base (518)..(518): a, c, t, g, unknown or other
  misc_feature (518)..(518): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtagaagaagccgtggggcctgagtgaggtctctgcaaggcttntggatacaccttcaccggctactatatacacgtgggtgcgacgacggcccctggacgaagggctggagtggagtgggatggatcaacctaacagtggtgacaacaaaactatgacacagtaagttcgagggcagggtacacagtagacgacgggacacgtaccatacagacaacacgcctaacgagtgggagcgtaggacgcgaggtcgagagactcgaggaacgacgacggtccgttagttacgtacgttgttggagaaggaggnggtaagtagttagttaagttttgggtaaggg

SEQ ID NO: 355721 - DNA, 631 bp, Homo sapiens
  misc_feature: GZ8MTXP01CG9Q4.45.78.H01.1.454.CMB.2.raw
tcagacgcgatcgacacgaccggtgctcgatttagtgtgagtagtttggggttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtcatcagcacagcctacatggagctgagcaggctgagatctgacgacacggccgtgtattactgtgcgagaggcaaggtaattacgtagttttggagttggttagttcgggtaacgggttagtgggtacgtcggtcgggggaccgaacggggaccgacgggtcctaccgtctcctcacgcctaccgaccgaacgggccctacgtccggttcccttcccccgtggccccacccgtccgtaccgaacgtaccgcctacccgtcggtcgggggccacgtcggccggcccgtgggcctcggccgtcgggttaccgaaacgggtccttaccgttcccgttcggtaactccggtcgttccgtcgggacggtccggggttcgtaacgggg

SEQ ID NO: 355722 - DNA, 529 bp, Homo sapiens
  misc_feature: GZ8MTXP01B88E3.45.78.H01.1.454.CMB.2.raw
  modified_base (364)..(364): a, c, t, g, unknown or other
  misc_feature (364)..(364): n is a, c, g, or t
  modified_base (447)..(447): a, c, t, g, unknown or other
  misc_feature (447)..(447): n is a, c, g, or t
  modified_base (450)..(450): a, c, t, g, unknown or other
  misc_feature (450)..(450): n is a, c, g, or t
  modified_base (461)..(461): a, c, t, g, unknown or other
  misc_feature (461)..(461): n is a, c, g, or t
  modified_base (469)..(469): a, c, t, g, unknown or other
  misc_feature (469)..(469): n is a, c, g, or t
  modified_base (503)..(503): a, c, t, g, unknown or other
  misc_feature (503)..(503): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagcgtggggcctcagtgaaggtctcctgcaaggcttcgtggactacaccttcaccggctactatatacacgtggtgcgacacggcccctggacaagggcttgagtggatgggatggatcaaacctaacaagtggtagcaacgaaaaactntgacaacgaagtaagtttcaaggggtcagggtcacgagtcgacgaggacacgtaccatcacgcaacacgacctacgagtggancgngagcgaggacngagatcgngaacgacacggccgttgtactacgttgttgacgngagcagtattacgtaagttttggaag

SEQ ID NO: 355723 - DNA, 545 bp, Homo sapiens
  misc_feature: GZ8MTXP01B6EFU.45.78.H01.1.454.CMB.2.raw
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (413)..(413): a, c, t, g, unknown or other
  misc_feature (413)..(413): n is a, c, g, or t
  modified_base (428)..(428): a, c, t, g, unknown or other
  misc_feature (428)..(428): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcgagtgaaggtctccgtgcaaggcttctggatacaccttcaccggctactatatacactgggtncgacncggcccctggacaagggcttgaggtggagtgggatggatcaacctaacagtggtgacaacaaaactagtgacacagtaagttcgaggggcagggtcacagtcgacgagggacacgtcancagcacagcctacgngtaggagacgtgacgcgaggtcgagtaggactgtcggaacgacgaccgggtccgttaggtaacttacgttggttgcgaagggacgaagaggtaagttcgttaagttttgggtaaggg

SEQ ID NO: 355724 - DNA, 535 bp, Homo sapiens
  misc_feature: GZ8MTXP01AMTM7.45.78.H01.1.454.CMB.2.raw
  modified_base (354)..(354): a, c, t, g, unknown or other
  misc_feature (354)..(354): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcaagaaccagggaaagcccctaagctcctgctctataaggcatctagttagaaagtgggtccatcaaggttcagccggcagtggatcgtgggacngaaattcactctacaccatcagcagcctgcagcctgatgtatttgactaactttatactgacccaataggtatggtattagtttattccgtacgttacggaccgtaaaggggaaccaaagggttaggaaaattcgaaaacgaacttggttcggctggacaacctatcttgtcttcgtaacc

SEQ ID NO: 355725 - DNA, 647 bp, Homo sapiens
  misc_feature: GZ8MTXP01BOQJ7.45.78.H01.1.454.CMB.2.raw
  modified_base (600)..(600): a, c, t, g, unknown or other
  misc_feature (600)..(600): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcagtgaaggtctcctgcaaggtcttctggatacaccttcaccggctactatatacactgggtgcgacaggcccctggacgaggacgtcgtaggtggagtagggtaggtagaggtactaacccgtaaaccgtaaagtaggtcggtaccgaacgtaaaactaagttacgcgaaaacccaagtaacggtttacgtacggggacggtacgggtacgtaccgaacgttagaacccggaacgggaaccggaacgtaccgacgttacaaaccggaccaacaccggtacccctaagaagttacgggaactccggtaggacggcgtaacgggtcgtacgaaggcttacgacgtacggactcgggctgtacgttacgtggttcgagaagnggcaaggtaagttagttgtttaggagttggttaacgttcggtaaggg

SEQ ID NO: 355726 - DNA, 563 bp, Homo sapiens
  misc_feature: GZ8MTXP01D0BZQ.45.78.H01.1.454.CMB.2.raw
  modified_base (225)..(225): a, c, t, g, unknown or other
  misc_feature (225)..(225): n is a, c, g, or t
  modified_base (398)..(398): a, c, t, g, unknown or other
  misc_feature (398)..(398): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagagccgtgggcctnagtgagtctctgcagtctctgatacacttcacgctactatatacacgtggtgcgacacggcccctggacaagggtcttgagtgggatggggatggactacaaaccctaacagtggtagacaacaaaaactatgacaacgaagtaacgtttcgaggggacagggtacaccgtanacggaaccgacgggacacgtccatcgagacaacgacgacctacgagtgggaacgtcgagacgcgtacggacgtagagtacgtcgacgaacgtacgacgggtccgttagtacttacgttggttgacggaaggagaacgtaggtattaggttaagttttggttaagg

SEQ ID NO: 355727 - DNA, 737 bp, Homo sapiens
  misc_feature: GZ8MTXP01ENRNB.45.78.H01.1.454.CMB.2.raw
  modified_base (252)..(252): a, c, t, g, unknown or other
  misc_feature (252)..(252): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctgagtgaaggtctcctgcaaggcttntggatacaccttcaccggctactatatacacgtggtgcgacgcggcccctggacaagggtcttgaggtggagtgggatggactaccaaccctaaacgaagtggtagaccaaacgtaaaaaacctagtcggaccaaacgtaaagggttaaacggttttaccggaagggggtcgtaaacgggggttacccaacccgtaaggttaccgggaaacccggaacgggggaaccctaaacccgggttaccccaaagttacccgaaacggacccgaaacccaacgggtacccctaaacggggtagttacgggggaaacgtccgttagggacggtacccgggagggttaccggtaggaaacggtcgttacccgaagggtaacccggaacgaaccggggtcccgttaagggttaccttaacggttggaccggacggtaagggtaacggaagtaaacggggtaattacgggtttaaggttttggggtttaacgggg

SEQ ID NO: 355728 - DNA, 600 bp, Homo sapiens
  misc_feature: GZ8MTXP01C5HBP.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggcttctggatacaccttcaccggctactatatacacgtgggtgcgacacggcccctaggacgaagggtcttggaggtggagtgggatggactacaaccctaacaagtggtggacaacaaaaaactatcgacaacgaaggtaacgtttcgagggggacacggggtaccaaccgagtacggaaccgaacgggaacccgaacggtacccatccgaagccaacacgacctacgacgtgggacgcgtgacgcgaggctgagactcgtacggaacgaacgacgggtaccgttgttaacgttacgttggttcggacggaaggaggcgaagggtaatttacggttaagttttgggtaaggg

SEQ ID NO: 355729 - DNA, 649 bp, Homo sapiens
  misc_feature: GZ8MTXP01DYVDD.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtcatcagcacagcctacatggagctgagcgaggctgagatctagacgacacggccgtagtacttactgtgcgaggaggcgaaggtaatttacggttagtttttgggagttgggtttagttcggggtaaacggttagtcgggtacgtcggtcgggggaccgaacgggaccgacgggtccaccgtctccgtcgacgccctaccgaaccgacgggcccacgtccggtcccttcccccgcggcccctaccccttccctaccgaacgccgcctacccgtcggtcgggggaccaaccggtcggcccgggtcccgtcgggtcctcggcccgtacgggttaccgaaacgggttccttaccgttccgttcgtaacgtccggtcgtcgtcggacgggccgggcgtaacggg

SEQ ID NO: 355730 - DNA, 618 bp, Homo sapiens
  misc_feature: GZ8MTXP01DIML0.45.78.H01.1.454.CMB.2.raw
  modified_base (485)..(485): a, c, t, g, unknown or other
  misc_feature (485)..(485): n is a, c, g, or t
  modified_base (509)..(509): a, c, t, g, unknown or other
  misc_feature (509)..(509): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcaacagaagtttcgagggcagggtcacatcgacagggacacgtcatcagcacacgcctacagtggagctgagcaaggctagagatcgtagacgacgacggcgttagttacttacgtggtgacggaggaggcgtaaggtaatttacgttagttttgggagttggttattcggaaacggttagtcgggacgtcggtcggggaccgaacgggacccgtacggtccaccgtctccgtacacgccctaccgaaccgacgggcccacgtccgtccctccccgngccacccgtctaccgaacgcgccnccgtcggacgggcacgcggcccgccgtcggcgtcgccggttcgacgaaaccggttccttaccgttcccgcgtaacgtcggtcgttacgcggacgggtccggcgtaacgg

SEQ ID NO: 355731 - DNA, 560 bp, Homo sapiens
  misc_feature: GZ8MTXP01CCT39.45.78.H01.1.454.CMB.2.raw
  modified_base (287)..(287): a, c, t, g, unknown or other
  misc_feature (287)..(287): n is a, c, g, or t
  modified_base (481)..(481): a, c, t, g, unknown or other
  misc_feature (481)..(481): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtncgacacggcccctggacaagggcttaggagtggagtgggatggatcgaaaccctaacagtggtaggacaacaaaaaactatgacaacaggtaaagtttcgaacggggcaagggtccaaccgtagcgaaccgagggacacgtaccaatcgaagcaacagcctaacgagtggagcgtgaagcgagctgagactcgngaacgtacgacggtccgttgtacgttacttggttgacgaaggaaggcgtaagggtattacgttaagttttgggtaaggg

SEQ ID NO: 355732 - DNA, 580 bp, Homo sapiens
  misc_feature: GZ8MTXP01B3P5O.45.78.H01.1.454.CMB.2.raw
  modified_base (385)..(385): a, c, t, g, unknown or other
  misc_feature (385)..(385): n is a, c, g, or t
  modified_base (531)..(531): a, c, t, g, unknown or other
  misc_feature (531)..(531): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctccgtgacaaggtcttcgtggactacaccttcgaccggtctactatatacacgtggtgcgacgcggcccctaggacgaagggtcttggagtggagtgggataggactaccaaaccctaacgaagtggtacgacaacaaaaacttntcgacaacgagtaacgttcgagggcacgggtcacagcgacgaggacacgtcatcacgcacgacacctagagtggacgacgtagacgcgaggcgtaggagtacgtcgtaggaaccgacgacgggtcccgttagttacgttaggttgnggacggaaggacggaacgtaaggtagttacggttgttttaagggtaagg

SEQ ID NO: 355733 - DNA, 678 bp, Homo sapiens
  misc_feature: GZ8MTXP01CO3H2.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggtaattacgtattttggagttggttagtcggtaacggttagtgggacgtcgtcgggggccgtaaggggacctacgggtccacccgtcctcccgtacgacgcccctacccgacccgaacgggcccctaacgttcccggttccccttcccccgtcgggtcccctacccccggttcccctacccgaaacgaccgacccgtaaccccgtccggtcggggggccaaccggtaccggcccggggtccccgtgggggtccctcgggttccgttcggggttaccgtaaacggggtacccttaccgttcccgttcggaaccgtccgtccgttcgtcgggacggtccggggccgtaacggggg

SEQ ID NO: 355734 - DNA, 600 bp, Homo sapiens
  misc_feature: GZ8MTXP01DIST6.45.78.H01.1.454.CMB.2.raw
  modified_base (287)..(287): a, c, t, g, unknown or other
  misc_feature (287)..(287): n is a, c, g, or t
  modified_base (312)..(312): a, c, t, g, unknown or other
  misc_feature (312)..(312): n is a, c, g, or t
  modified_base (518)..(518): a, c, t, g, unknown or other
  misc_feature (518)..(518): n is a, c, g, or t
  modified_base (563)..(563): a, c, t, g, unknown or other
  misc_feature (563)..(563): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacagtggagctgagcaggctgagntctgacacgacggccgtgtattacngtgcgtagaggcaggtaattacgtagttttggagtaggtttagttcggaaacggttatcgggtaacgtcggttacggggaccgaaaggggacccgtacgggtcctaaccgtctccctcgacgcctcccaacgacgggcctactccggtccttcccccggacccctacccgtcctaccgaagaacgtccaccgtcgcggggccacgnggcccgcctgggctcggccgtcggcgaaacggtcttacctttccncggtaacgtcgcgttcgcggacgggtcggcggtaagg

SEQ ID NO: 355735 - DNA, 536 bp, Homo sapiens
  misc_feature: GZ8MTXP01DF2GK.45.78.H01.1.454.CMB.2.raw
  modified_base (446)..(446): a, c, t, g, unknown or other
  misc_feature (446)..(446): n is a, c, g, or t
  modified_base (464)..(464): a, c, t, g, unknown or other
  misc_feature (464)..(464): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctccgtgcaaggcttcgtggatacaccttcaccggctactatatacactgggtgcgacacggcccctggacaagggcttgagtggatgggatggatacgaaaccctaaacaaatggtaggacaacaaaaaacttatgacacgaagtaagtttcaggggcacgggtcaaccgatacgacagggacacgtcatcagcacagcctagatgagcngagcgagctgagatccgngaacacgaccggtccttgtaattacgttgttgcggaagaggaataggaatttacggtaagtttttggtaagg

SEQ ID NO: 355736 - DNA, 607 bp, Homo sapiens
  misc_feature: GZ8MTXP01CL22F.45.78.H01.1.454.CMB.2.raw
  modified_base (389)..(389): a, c, t, g, unknown or other
  misc_feature (389)..(389): n is a, c, g, or t
  modified_base (511)..(511): a, c, t, g, unknown or other
  misc_feature (511)..(511): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtagaaggaagccgtggggcctcgagtgaaggtctcctgacgaaggcttcgtggactaccacctcaccggctactatatacgacgtggtgcgacgacggccccgtaggacgaagggtcttggagtgggagtgggatcggataccaaacctaacgaggtggtacggacaaactaaaaactntcgacaacgaggtaagttcgaggggtacgagggtaccacgatacggaccgaagggactacgtacatacacgacacgacgacctagagtggagacgtagacgtcgaggacgtagagattacgnggaaccgtacgacgggtccgttagttaacgtcgttcggttcggacggaaggtacggaacgtaaggttaacgtttaggttaagttttggggtaaggg

SEQ ID NO: 355737 - DNA, 299 bp, Homo sapiens
  misc_feature: GZ8MTXP01AO1GK.45.78.H01.1.454.CMB.2.raw
  modified_base (289)..(289): a, c, t, g, unknown or other
  misc_feature (289)..(289): n is a, c, g, or t
  modified_base (295)..(299): a, c, t, g, unknown or other
  misc_feature (295)..(299): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcacatgaccaggacacgtcatcagcacagcctacatggagctgagcgggctggcaaggcncatagnnnnn

SEQ ID NO: 355738 - DNA, 618 bp, Homo sapiens
  misc_feature: GZ8MTXP01CX3SL.45.78.H01.1.454.CMB.2.raw
  modified_base (386)..(386): a, c, t, g, unknown or other
  misc_feature (386)..(386): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagagccgtggggcctcagtgaaggtctcctgacaaggtcttcgtggataccaccttcaccggctaactatataccgacgtggtgacgacgacggcccccgtaggaccaagggcttaggagtggagtggggatggactcaaacctaacgagtggtgacaacgaaaactatcgacanaaggtaacgttcgagggtcgacgggtcaacgatcggaccgagggaccacgtaccatacacgcaacgaacgtccgttaacgacgttggaacgtcgtaaggacgtaccggagggttaccgtaggtaagacgttccgtagggaaaccgacggttaaccggtacccgttgtttaaacgttcgaggttcgacgtaaggacggtgtaagggtatttacggttaagttttgggtaaggg

SEQ ID NO: 355739 - DNA, 746 bp, Homo sapiens
  misc_feature: GZ8MTXP01EQAVQ.45.78.H01.1.454.CMB.2.raw
  modified_base (253)..(253): a, c, t, g, unknown or other
  misc_feature (253)..(253): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgtagtcgtggggctggaggtagaagagccgtggggcctcgagtgaggtctctgcaggcttcnggatacaccttcaccggctactatatacacgtgggtcgcgacgacggccccgtggacgaagggcttaggaggtggagtgggatggactacaaaccctaacaagtgggtacggacaaactaaactaagcgaacaaacgtaaggtaaacggttttacgaacgggggtacggaacggggttacccaaacccgtaagttaccggaaacccggtaaggggaacccctaaccggttaccccaaacgttaccgaacggaccaaaccgacggacccttaacgaggggttacggggaaacgtccgtaggaacggtcggacgggtaccgtaaggaacggtacgtaccgtacggaacccggaaccgtaaccggggttccgtacggtttaaacgttaccggttaggttacggttaccgggaagggtaacggggtaacgtaaacggggtttaaagtttaaccgggtttaggttttttaacgggggttaaacggtttttaacggggg

SEQ ID NO: 355740 - DNA, 683 bp, Homo sapiens
  misc_feature: GZ8MTXP01EXQX6.45.78.H01.1.454.CMB.2.raw
  modified_base (587)..(587): a, c, t, g, unknown or other
  misc_feature (587)..(587): n is a, c, g, or t
  modified_base (635)..(635): a, c, t, g, unknown or other
  misc_feature (635)..(635): n is a, c, g, or t
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtagaagaacgccgtggggcctcgaggtgaaggtctcctgacgaaggtcttcgtggatacgaccttcgaccggctactatatacacgtggtcgcgacgacggtccccctagggacgaagggtcgttaggaggtgggagtgggggatagggaactaccgaaacccgtaaacgaagtgggtacggaacaaacctaaaaaactagtcgacaaacgtaaggtaaacgttttcgaagggggaccgtaaggggtaccaaccgtaagtacggaacccgaacgggggaacctaaccggtacctaacgtaccgaaggacccaaacgaaccgtaccccgttaaacggaaggttacggggaacgtcggtacggacgaccggacggtacgnggaacgtacgtacgtacggaacggacgacgggtcgttacgtagttacnggttcgacgaaggacggtaagaaggtagttaggttgttttgggtaagg

SEQ ID NO: 355741 - DNA, 699 bp, Homo sapiens
  misc_feature: GZ8MTXP01DQJHH.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtgggcctgagtgaggtctcctgcaggtcttcgtggatacaccttcaccggtctactatatacgacgtgggtgcgacgacggcccctaggaacgaagggtcttaggagtgggagtgggatggactaccgaaacctaacgagtggtcggacaacaaaaactatcggacaacgtaaaggtaacgtttcgaacggggtacgaacggggtaccaaccgtagtacggaaccgtaacgggaaccgtaaccggttaccaacgtaccgaacggaacccaaaccgaacggtacccttaacggacggttaacggggtacgaccgtaggaacggcgaaagggtccgtaggacgtacgttacgacgggaaccggaaccggttaccgggtaccgttacggttaacgttaccgttgggttacggaccgggaagggtaacggaaccggttaaagggtaaccgtttaacgggtttaacggtttttggggttaagggg

SEQ ID NO: 355742 - DNA, 602 bp, Homo sapiens
  misc_feature: GZ8MTXP01AL3O4.45.78.H01.1.454.CMB.2.raw
  modified_base (311)..(311): a, c, t, g, unknown or other
  misc_feature (311)..(311): n is a, c, g, or t
  modified_base (319)..(319): a, c, t, g, unknown or other
  misc_feature (319)..(319): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtcatcagcacagcctacatggagctgagcaggctgagatctgacgacacggccgtgtattacngtgcgagnggcaggattacgattttggagtgttatcgggaacggtatggacgtcgtcggggacgaagggcacgggtccaccgtctcctcacgccctcaccgaacgggcccagtccgggtccttcccccgtggtcccaaccccgggttcctacccgaacgacgccgtacccctcggtcgggggaccacgtcgggtccggccccgttggggccttcggccctcggggttcgaaacggggccttaccgttcccttcgggcttcgccgttcgcggacggcccgggttccgtgggg

SEQ ID NO: 355743 - DNA, 575 bp, Homo sapiens
  misc_feature: GZ8MTXP01B24NZ.45.78.H01.1.454.CMB.2.raw
  modified_base (350)..(350): a, c, t, g, unknown or other
  misc_feature (350)..(350): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggcttcgtggatacaccttcaccggctactatatacacgtgggtgcgacacggccccctggacgaagggtcttggagtggagtgggatggactacaaccctaanagtggtgacaacaaaactatgacaacgagtaacgtttcgacggggacgacgggtcacgacgtacgaccgaaggggaccaccggtaccactacgacgacaacacgaccctaacgagtaggacgacgtggaacgcgaggcgtagagtacgtcgagaaccgacgacggtccgttagttacgtagttggcgacggaagaggcgtaaggtagttagttgtttgggtaagg

SEQ ID NO: 355744 - DNA, 770 bp, Homo sapiens
  misc_feature: GZ8MTXP01C4588.45.78.H01.1.454.CMB.2.raw
  modified_base (272)..(272): a, c, t, g, unknown or other
  misc_feature (272)..(272): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcaggctgagatctgacgacacggccgtagtattactgtgcgaggaggcaggattacgtattttgggagttggttattcggaaacgggttatgggacgtcgtgggggcctaaggggccaacgggtcacccggtctcctcacgtccctacccgaccgaaacggggcccctacgttcccgggtccctttaccccccgtgggtccccctaacccccgggttacccctttaccccgtaaacggaccgtacccggtaaccccgttccggttccgggggggggaccctaaacccgggtaccgggaccccgggggtccccccggttcggggggtcccgtttccggggttcccccgggtttacgggggtttaccccggaaaacgggggttaacccctttaaaccccgtttttccccggttaccggtaacccggtttcccgggtaacccgggtttccggttcggggaacgggggtcccgggggttccggtttaacccgggggg

SEQ ID NO: 355745 - DNA, 579 bp, Homo sapiens
  misc_feature: GZ8MTXP01AMOZA.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctcctgcaaggtcttcgtggatactaccttcaccggtctactatatacacgtgggtgcgacacggcccctggacgaagggcttaggaggtggagtgggatggactaccgaaacctaacaagtggtaggacaacaaaactatgacaacgagtaagtttcgagggacagggtacacgagtacgacgaggacacgtccatacgacgaccacgacgacctacggagtacggagcgtagacgcgaggcgtagtagagtacctaggaacgacgacgggtccttagtatcgttgttcggacggaaggtacggaagtaggtaattacggttaagttttaagggtaaggg

SEQ ID NO: 355746 - DNA, 559 bp, Homo sapiens
  misc_feature: GZ8MTXP01A69LK.45.78.H01.1.454.CMB.2.raw
  modified_base (198)..(198): a, c, t, g, unknown or other
  misc_feature (198)..(198): n is a, c, g, or t
  modified_base (251)..(251): a, c, t, g, unknown or other
  misc_feature (251)..(251): n is a, c, g, or t
  modified_base (269)..(269): a, c, t, g, unknown or other
  misc_feature (269)..(269): n is a, c, g, or t
  modified_base (284)..(284): a, c, t, g, unknown or other
  misc_feature (284)..(284): n is a, c, g, or t
  modified_base (287)..(287): a, c, t, g, unknown or other
  misc_feature (287)..(287): n is a, c, g, or t
  modified_base (320)..(320): a, c, t, g, unknown or other
  misc_feature (320)..(320): n is a, c, g, or t
  modified_base (343)..(343): a, c, t, g, unknown or other
  misc_feature (343)..(343): n is a, c, g, or t
  modified_base (373)..(373): a, c, t, g, unknown or other
  misc_feature (373)..(373): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtcctccttccaccctgtctgcatctgtagganacagagtcaccatcacttgccggcagtcagagtattagtactggtgctggatnagcagaaacgaggaaacnccctaagctctgctntanagcatctagttagaagtcgggccatacgaggtnagccggcagtggatcgagggacngaattcactctacaccatcagcagcctgcngtacctgtatgtatttcgaactaaatttacttactgtaccaaatagtataggtaactttagttaacgttcgtaaccggttcggaacctaaggggtaaaccgtaaggaagggtaaaacttacgaaaaacggtacgttcgggttcggttactcggacctaactactcttacgttcttaacgttaaccg

SEQ ID NO: 355747 - DNA, 631 bp, Homo sapiens
  misc_feature: GZ8MTXP01DVKPS.45.78.H01.1.454.CMB.2.raw
  modified_base (599)..(599): a, c, t, g, unknown or other
  misc_feature (599)..(599): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctagacgacacggccgtgtattacgtgtgcgagaggcaggattacgtagttttggagttggttagttcggaacggttatgggacgtcgtacggggaccgaacggggacctacgggtccacccggttctccctcgacgccctacccaacccgaacgggtcccctaacgtccgggttccccttcccccgtggcccctaccccgttccctacccgaaacgacggcctacccgttcggcgggggaccacgacggccggcccgttggggcctcggccgtcggttacgaaacgggtccttaccgttcccgttacgnttccggcgttcgcggacgtccgggcgtcgggg

SEQ ID NO: 355748 - DNA, 652 bp, Homo sapiens
  misc_feature: GZ8MTXP01DEPD2.45.78.H01.1.454.CMB.2.raw
  modified_base (289)..(289): a, c, t, g, unknown or other
  misc_feature (289)..(289): n is a, c, g, or t
  modified_base (349)..(349): a, c, t, g, unknown or other
  misc_feature (349)..(349): n is a, c, g, or t
  modified_base (389)..(389): a, c, t, g, unknown or other
  misc_feature (389)..(389): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccacgctgtctgcatcgtggtaggagacagagtcacatcacttggccggccagtcagatattagtaacgtggtgctggtatcagacaagaaacgaagggaacgcccctaagctacngctctaatagctatacttagtttaagaaaggtcgggtaccatagtaggttcagtcggacnggtagatacgtgggaacagtaaattccaactctacaccanacgagctacgctgacgacgtcgtagtagttagttacgtttacgtaacttaactttacgttacgtacgtaacctaagttaagttagttaagttaacgtttaacgtttaccggttaccggtaccgggttaaccgggaaaccggtaaaacggggttaaacggttaaagggtaaacgttaaacgttaaaccgtaaaacggttacgttcggttacggtaacgtacgtaacccgtaacgtcgtttaccgttaacgtttcccgttaaccg

SEQ ID NO: 355749 - DNA, 514 bp, Homo sapiens
  misc_feature: GZ8MTXP01BV9UK.45.78.H01.1.454.CMB.2.raw
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (495)..(495): a, c, t, g, unknown or other
  misc_feature (495)..(495): n is a, c, g, or t
  modified_base (497)..(497): a, c, t, g, unknown or other
  misc_feature (497)..(497): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctggacaaggcttgagtggatgggatggatcaacctaacatggtagacaacaaaaactatgacacagaagtttcgagggcagggtcacatgacaggacacgtaccatcagcacacgacctaacgagtagggagcgtaggacgcggacgcgtacgaggtactcgtagaacgacgacgcgttatgttcgngngngaagngngagtagttagtgttgtg

SEQ ID NO: 355750 - DNA, 610 bp, Homo sapiens
  misc_feature: GZ8MTXP01CWG5F.45.78.H01.1.454.CMB.2.raw
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagaagccgtggggcctcagtgaggtctctgcaggcttcnggatacnctccgacggctactatatacgacgtggtgcgacgacggcccctggacgaagggtcttaggagtggagtggggatggactccgaaaccctaacaagtggtggacaactaaaaactatcgacaacgtagtaagttcgaggggtcgacgggtacactagtacggaccgagggaccaccgttaccgaatacgaacgcctaacgacgtaccctaacgagtacgggacgtccgtaggaacgcggaaggtcgtaggagtacgtcgacgtaacggacgacgggtaccgttagttacgttcttaggttgaccggaagggaggtcgtaagggtacgtttaaggttggtttttgggtaaggg

SEQ ID NO: 355751 - DNA, 623 bp, Homo sapiens
  misc_feature: GZ8MTXP01COHTG.45.78.H01.1.454.CMB.2.raw
  modified_base (296)..(296): a, c, t, g, unknown or other
  misc_feature (296)..(296): n is a, c, g, or t
  modified_base (387)..(387): a, c, t, g, unknown or other
  misc_feature (387)..(387): n is a, c, g, or t
  modified_base (450)..(450): a, c, t, g, unknown or other
  misc_feature (450)..(450): n is a, c, g, or t
  modified_base (499)..(499): a, c, t, g, unknown or other
  misc_feature (499)..(499): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtagaagaagccgtggggcctgagtgaaggtctcctgcgaaggtcttcgtggataccaccttcaccggtctactatatacacgtgggtncgacgacggcccctggacgagggtcttaggaggtggagtgggatgggaactaccaaaccctaacaaggtggtacggacaacgtaaaaactntgaccaaacgagtaagttcgagggcagggtacacgagacgacgaggacacgtccgactcgacncacacgccctaagacgtacgggagccgtaggacgtcgagggtctagganacgtcgtaggaaccggtacgaccggggtccgttaagtttaacgttacggttcggttgggaccggaagggacggtaacggtaagggttaacgtttacgggtttaaggtttttaagggttaagggg

SEQ ID NO: 355752 - DNA, 569 bp, Homo sapiens
  misc_feature: GZ8MTXP01D9SO1.45.78.H01.1.454.CMB.2.raw
  modified_base (243)..(243): a, c, t, g, unknown or other
  misc_feature (243)..(243): n is a, c, g, or t
  modified_base (277)..(277): a, c, t, g, unknown or other
  misc_feature (277)..(277): n is a, c, g, or t
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
  modified_base (315)..(315): a, c, t, g, unknown or other
  misc_feature (315)..(315): n is a, c, g, or t
  modified_base (327)..(327): a, c, t, g, unknown or other
  misc_feature (327)..(327): n is a, c, g, or t
  modified_base (347)..(347): a, c, t, g, unknown or other
  misc_feature (347)..(347): n is a, c, g, or t
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagcgtgggctgagtgagtctctgcagctcgngatactacctcgaccgtctactatatacagtggncgacncggccctgacgaggtctgagtggagnggatganaccaacctaaanagtggacgacaacgaaaatngacagagtacgttcgagggtcgaggtcacgagtacgacgaggactaccgtacatacgacgacacaacgtacctaacggagtcgggaagcgtaggaacgcgaaggtactagacgtactcgacgggaaccgtaccggttcgggtacgttagttaacgttagttggttcggacggaaggacggtaagtaaacggtagtttacggtttggttttaagggtaacggg

SEQ ID NO: 355753 - DNA, 797 bp, Homo sapiens
  misc_feature: GZ8MTXP01B8AM8.45.78.H01.1.454.CMB.2.raw
  modified_base (188)..(188): a, c, t, g, unknown or other
  misc_feature (188)..(188): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaanaatggtggcacaaactatgcacagaagtttcagggcagggtcaccatgaccagggacacgtcatcagcacagcctacatggagctgacgcgaggctgagatcgtcgacgaccgacggccgtagtacttacgtggtcggacggaggacggacgtaaggttaaacgtttacggttaagttttttacggggaaggtttagggttttaaggtttaccggggtaaaacggggtttaagttcgggggtacggtttacccccggggtaaggggggtacccgtaaaacggggggtaccccgtaaaccgggggttaccctaaccccgggttaccgttcccgttaccgaaccggtccccttaacccggaaacccggtaaacccggggtcccctaacgttcccgggttacccctttcccccggacggtccccctaccccgttcccgtaaccgaacgaccggtacctacccgttcggggtacgggggacctaacgccgggccggtccccggtggggtcctcggttcccggttgggttaaaccgtaaacgggtcctttacccggttccttccggtaacgtccggtcgtacggtcgggacgggtcccgggttaaggtccgggg

SEQ ID NO: 355754 - DNA, 626 bp, Homo sapiens
  misc_feature: GZ8MTXP01DB3KD.45.78.H01.1.454.CMB.2.raw
  modified_base (295)..(295): a, c, t, g, unknown or other
  misc_feature (295)..(295): n is a, c, g, or t
  modified_base (398)..(398): a, c, t, g, unknown or other
  misc_feature (398)..(398): n is a, c, g, or t
  modified_base (534)..(534): a, c, t, g, unknown or other
  misc_feature (534)..(534): n is a, c, g, or t
  modified_base (576)..(576): a, c, t, g, unknown or other
  misc_feature (576)..(576): n is a, c, g, or t
  modified_base (585)..(585): a, c, t, g, unknown or other
  misc_feature (585)..(585): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcgagtcgtgggctggaggtagaagaagccgtggggcctgagtgaaggtctctgcaaggtcttgtggactacaccttcgaccggctactataatacacgtgggtncgacgcggccccgtggaaccgtaagggtcttaggaggtcgggtaagtgggggtatagggaactaccaaaccccgtaacagttggcgacaaacgtaaaaacctntcgactaacgaagttacgttcgaggggctaacgggtaccaccgtaagacggaacgaagggacccacggttccacgtacgaacgactaacacgtaccctaagacgtggaagtcgagcgtacgaggtacaggagtacncgtacggaaccacggcggttaccgttgttaacttcgttaggngacggaagnggtaacgttaaggtaactttaggtttaagtttgggttaagg

SEQ ID NO: 355755 - DNA, 638 bp, Homo sapiens
  misc_feature: GZ8MTXP01CAHUT.45.78.H01.1.454.CMB.2.raw
  modified_base (275)..(275): a, c, t, g, unknown or other
  misc_feature (275)..(275): n is a, c, g, or t
  modified_base (351)..(351): a, c, t, g, unknown or other
  misc_feature (351)..(351): n is a, c, g, or t
  modified_base (599)..(599): a, c, t, g, unknown or other
  misc_feature (599)..(599): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtcctccttccaccctgtctgcatctggtaggagacagagtcaccatcacttggccggcagtcagtagtattagtactggtgctgtatcagacaagaaccgagggaaacnccctaagctctgctactaagtaggctagttactaaggtttaagaaggtcgggtaccagtacgaaggtcaggccganaggtgatcgtaagggactaagtaacttcactctacacatcgacgcacgcctgaccacgtaccgtagtattacgttaactttcaaaccttaactttaacttacgtacgtaaccctaaagtagttaagtagtaacgtttacggtttacgttaccgggtaccggttaccgggaaccggtaaaacggggtaaccgtaaaggggttaacgtaaaaccgttacggtaaaaacggtcgttagggttcgaccggtnaccctaacgtacttcgttacgttccgtttaactaacccg

SEQ ID NO: 355756 - DNA, 600 bp, Homo sapiens
  misc_feature: GZ8MTXP01CB6X8.45.78.H01.1.454.CMB.2.raw
  modified_base (563)..(563): a, c, t, g, unknown or other
  misc_feature (563)..(563): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtagaagaagccgtggggcctcgaggtgaaggtctccgtgacgaaggtcttcgtggactacctaccttcaccggtctactatactacacgtgggtgcgacgacgggccccctaggaaccgaagggtcttaggaggtgggagtgggggattaggaactaccaaaccctaaacgaagtgggtacgaccaaacgaaaaacttagtgacaagaagtaagttcgaggggcagggtccacgagtcgaaccgaggaccacgtcatcagccaacgacgcctaacgagtgggacgcgtagacggccgaggcgtagacgtatcgacgaacgacgacggtcgttagtagtcgttggcggcgaagnggaacgtaggtaagttacggttaagttttgggtaagg

SEQ ID NO: 355757 - DNA, 621 bp, Homo sapiens
  misc_feature: GZ8MTXP01AIAXH.45.78.H01.1.454.CMB.2.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
  modified_base (354)..(354): a, c, t, g, unknown or other
  misc_feature (354)..(354): n is a, c, g, or t
  modified_base (480)..(480): a, c, t, g, unknown or other
  misc_feature (480)..(480): n is a, c, g, or t
  modified_base (566)..(566): a, c, t, g, unknown or other
  misc_feature (566)..(566): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgngggctgaggtgaagagcgtgggcctnagtgaggtctctgcaggcttcngatacacttcaccggctactatatacacgtgggtcacgacgacggcccctagggaaccaagggtcttaggaggtcgggaagtggggatggaactaccgaaaccctaanaaggtcggtacggaacctaacaaaaaacgttgtcgacaaacggtaagttaacggtttcgacggggacgtacggggtacccaaaccgtagtacggaaccgagggacctaccggtaccaactcgaacncaacacgtacctaacgaagtgggaactcgtagaggcgaggtcgtagagtactcgtggaacgacgccgggtaccgttagtacttcgnggttccgagggaacggagtaacgtaaggtaccgttaggttgtttaagggtaaggg

SEQ ID NO: 355758 - DNA, 669 bp, Homo sapiens
  misc_feature: GZ8MTXP01CU3IE.45.78.H01.1.454.CMB.2.raw
  modified_base (188)..(188): a, c, t, g, unknown or other
  misc_feature (188)..(188): n is a, c, g, or t
  modified_base (292)..(292): a, c, t, g, unknown or other
  misc_feature (292)..(292): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaanaatggtggcaacaaactatgacacagaaagtttcagggcagggtcaccatgaccaggacacgtccatcagcacagcctacatggagctggagcgagcgtgaagntcagacgacacggcgtgtatacgtgtgcaggagcaggtaattagtagttttggagttggttagttcggtaacgttatcggtaacgttcggacgggggacccgaaacggggaccccgaacgggtccctaacccgttccctacccgtacgaccgtaccctacccgaaccggtaccggtacccctacgttcccgttccccttccccgtcgtacccctaccccgtacccgtaaccgtaacgaccgaccgtacccgtcgggccgggaccaccgaccggtcccggtcccgtacgggcctcggccgttacggttaaccgtaaccggtacccttaccgttccgttacgtaacgtccgtccgttcggacggacggtcggcggtcgg

SEQ ID NO: 355759 - DNA, 595 bp, Homo sapiens
  misc_feature: GZ8MTXP01EJ5W5.45.78.H01.1.454.CMB.2.raw
  modified_base (188)..(188): a, c, t, g, unknown or other
  misc_feature (188)..(188): n is a, c, g, or t
  modified_base (270)..(270): a, c, t, g, unknown or other
  misc_feature (270)..(270): n is a, c, g, or t
  modified_base (317)..(317): a, c, t, g, unknown or other
  misc_feature (317)..(317): n is a, c, g, or t
  modified_base (536)..(536): a, c, t, g, unknown or other
  misc_feature (536)..(536): n is a, c, g, or t
  modified_base (594)..(594): a, c, t, g, unknown or other
  misc_feature (594)..(594): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaanaatggtgcacaaactatgcacagaagtttcagggcagggtcaccatgaccaggacacgtccatcagcacagcctacatgganctggagcgagtcgtgaaggctctagacgacgacggcgtgtattacgngtgacgagagacaaggtaacttacgtagtttttaggagttggttaagtcggaaacgttagtcggtacgtcgtggggacctaagggaccgacggttccaccgtctccgtacgacgccctaccgaaccgtaacggccctacgtccggtccttccccgtggcccctaacccgttccaccgaacgccgacctaccgtcgtacggggaccacgtcgccgtccgngggctgccgtggttacgacggtcttaccttcgttacgctcgctcgcggacgtcggcgng

SEQ ID NO: 355760 - DNA, 777 bp, Homo sapiens
  misc_feature: GZ8MTXP01CGQSY.45.78.H01.1.454.CMB.2.raw
  modified_base (228)..(228): a, c, t, g, unknown or other
  misc_feature (228)..(228): n is a, c, g, or t
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (276)..(276): a, c, t, g, unknown or other
  misc_feature (276)..(276): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtagaagagccgtgggcctnagtgagtctccngcaggctntgatacacttcaccggctactatatacncgtgggtgcgacgacggccccgtggacgaagggtcttggacggtggagtggggagtaggactacgaaaccctaacgaagttgggacggaccaaactaaaaaaaccgttagtaacgacctaaacgtaaagggttaaacgggttttaccgaaacgggggtacgtaacggggttacccgaaaccgtaacgttacgggaaaccccggtaaacgggggaacccgtaaccgggttaacccctaaccgttacccgaacggaacccctaaaccgaaccggtaaccccgtaaaccggtaagggttacggggtaaacggacccggtttaaggaacggaccgggacgggtacgtacgggtaagttacgtacgtaccggaaacccgggtaacggttacccgggttacccggttaggtttaaccgttcggttacggttcgggaccgggtaaggacggggtaacgtaacggggttaaacgttttacggtttaaggttttttcggggttaaagggg

SEQ ID NO: 355761 - DNA, 606 bp, Homo sapiens
  misc_feature: GZ8MTXP01AQDLL.45.78.H01.1.454.CMB.2.raw
  modified_base (252)..(252): a, c, t, g, unknown or other
  misc_feature (252)..(252): n is a, c, g, or t
  modified_base (526)..(526): a, c, t, g, unknown or other
  misc_feature (526)..(526): n is a, c, g, or t
  modified_base (557)..(557): a, c, t, g, unknown or other
  misc_feature (557)..(557): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagcctggggcctcagtgaaggtctcctgcagtcttcgnggactacacttcaccggctactatactacgacgtgggtcgcgacgacggccccgtaggacgtaaggggtcttaggaggtggaggtgggatggactaccaaacctaacgagtggtacgacaacaaaaactgtcgacaacgaagtacgttcgagggacgacgggtaccacgagtacgaaccggacggacctaccggtaccaagtccgaacgaccaacgacgtaccctaaggacgtacgggacgcgtaggacgcgaggtcgtaggacgtcgtaccgngaacgacgacggtccgttagttacgttacgnggttcgacgaaggagaacgtaaggtacttaggttaagtttgggtaacgg

SEQ ID NO: 355762 - DNA, 607 bp, Homo sapiens
  misc_feature: GZ8MTXP01EUTXH.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtattactgtgcgagagcaggaattacgtattttggagtggttattcggaacggttagtggacgtcgtggggacgaacggggaccacgggtcaccgtctcctcacgcctaccacgaacgggcccacgtccggtccctccccgtcgcccaccctccctaccaacgacgcctacccgtcggtcgggggccacgacggccggcccgtggggctcggccgtcgggttacgaaacgggtaccttaccgtttcccgttcggtaacgtccggtcccggttcgacgggacggccgggggttcgtcggggg

SEQ ID NO: 355763 - DNA, 578 bp, Homo sapiens
  misc_feature: GZ8MTXP01DOAYG.45.78.H01.1.454.CMB.2.raw
  modified_base (349)..(349): a, c, t, g, unknown or other
  misc_feature (349)..(349): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtagaagagccgtgggcctcagtgaggtctctgcaggcttcgtggatacaccttcaccggctactatatacacgtgggtgcgacgacggcccctagggacgaagggtcttggagtggagtgggatggactacaaaccctaanagtggtagacaacaaaactatgacaacgaaggtaagttcgaggggcgacgggtacacagtacgaccgagggacacgtccatcagcacacgacctaacggagtggaacgcgtagacgcgaggacgtagagactacgtcggaacgacgacggtccgttagttacgttacgttggttcggacggaaggacggtaacgtaagggtaagttacgtttaaggttttgggtaaggg

SEQ ID NO: 355764 - DNA, 657 bp, Homo sapiens
  misc_feature: GZ8MTXP01D5YCJ.45.78.H01.1.454.CMB.2.raw
  modified_base (224)..(224): a, c, t, g, unknown or other
  misc_feature (224)..(224): n is a, c, g, or t
  modified_base (284)..(284): a, c, t, g, unknown or other
  misc_feature (284)..(284): n is a, c, g, or t
  modified_base (614)..(614): a, c, t, g, unknown or other
  misc_feature (614)..(614): n is a, c, g, or t
  modified_base (626)..(626): a, c, t, g, unknown or other
  misc_feature (626)..(626): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagagccgtgggctnagtgaggtctctgcaggtctctggatacaccttcgaccggctactatatacacgtgggtncgacgcggcccctggaccaaggcttggagtggagtggggataggactacctaaacccctaaagaacgtgggtacggaccaaaccgtaaaaaaccttagtcgggaccaaaccgtaaaggtaacggttttacggaacgggggtacgtaacggggttaccaaccgtaagtacggaacccggaacggggaccaacccggttaccaatccgaaacggacccaacgttacgaccccttaaggacgttaggggaacgtcccgtaggaccgcccgttaggaccgttaggacgtaacgttccgaggaacccgaacgttcggtccgttagtacgttacgngttgacggaagnggaacgtaggtattaggttgtttggtaaggg

SEQ ID NO: 355765 - DNA, 607 bp, Homo sapiens
  misc_feature: GZ8MTXP01ETLE8.45.78.H01.1.454.CMB.2.raw
  modified_base (550)..(550): a, c, t, g, unknown or other
  misc_feature (550)..(550): n is a, c, g, or t
  modified_base (565)..(565): a, c, t, g, unknown or other
  misc_feature (565)..(565): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgcaaggtcttctggatacaccttcaccggctactatatacacgtgggtcgcgacgacggcccccgtagggacgaagggtcttggaggtgggagtggggatggatacgaaacctaacaagtggtaggacaacaaaaactatcgacaacgaagtaagtttcgaggggcgacgggtacaacgagtacggaacgagggacaacgtccaagtcgaagaccaacgacgaccctaacggagttagggaacgcgtaggacgcgaggacgtagtagacgtcgagaacgacgacgggtccgttagttacgttacgnggttcgacggaaggnggaaccgtaaggtaacgtttaggttaaggttttggttaaggg

SEQ ID NO: 355766 - DNA, 614 bp, Homo sapiens
  misc_feature: GZ8MTXP01DPJ58.45.78.H01.1.454.CMB.2.raw
  modified_base (460)..(460): a, c, t, g, unknown or other
  misc_feature (460)..(460): n is a, c, g, or t
  modified_base (511)..(511): a, c, t, g, unknown or other
  misc_feature (511)..(511): n is a, c, g, or t
  modified_base (525)..(525): a, c, t, g, unknown or other
  misc_feature (525)..(525): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagccgtgggcctgagtgaaggtctcgtgcgaggtcttctggactacgaccttcgaccgtctaactatactaacgacgtgggtcgccgaacgacggcccctagggaacgaaagggtcttaggaggtgggaagttggggattagggactaccgaaaaccccttaaacaaggttggtacggacaaacgtaaaaaccttatcggacaaacgtaagtaaagtttcgaaggggcaacgggtaccaaccgtaanacggaaccgagggacaccgtaccatcgagacaacacgaccagagtggaacncgagaacgcgacgngtagaagtctacgagaaccggacaccgggtcttgtaactcgttgcgacgaaggcggaataagggtaattacggttaagttttggtaagg

SEQ ID NO: 355767 - DNA, 608 bp, Homo sapiens
  misc_feature: GZ8MTXP01EE8R2.45.78.H01.1.454.CMB.2.raw
tcagacgcgatcgacacgaccggtgctcgatttagtgtgagtagtttggggttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggcgtgagatcgtagacgacacggccgtgtattactgtgcgagaggcaaggtattacgtattttggacgttaggttatcggaacgtatgggacgtgtacggggacaacgggaccgacggtccaccgtctccgtacacgccctacccgaaccgaacgggccctacgtccggttccctccccgtggtcccctaccccgtcctaccgaacggaccgccgtccgtcggcgggaccacgtcggccggtccgtcggctcggttccgtcggttacgaacggtaccttaccgttccgttacgtcgtccgtcgttcgtcggcgggtcggttcgtcgg

SEQ ID NO: 355768 - DNA, 590 bp, Homo sapiens
  misc_feature: GZ8MTXP01A42M9.45.78.H01.1.454.CMB.2.raw
  modified_base (317)..(317): a, c, t, g, unknown or other
  misc_feature (317)..(317): n is a, c, g, or t
  modified_base (586)..(586): a, c, t, g, unknown or other
  misc_feature (586)..(586): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacaatggtgcacaaactatgcacagaagtttcagggcagggtcaccatgaccaggacacgtccatcagcacagcctacatggagctgagcaggctgagatctgacgacgacggcgtgtattactgtgcgagnggcaggtaattacgtattttggagttggttagtcgggaacgttagtgggacgtcgtcggggaccgaagggaccgacgggtactaccgtctcctcacgcctccaaccgacgggccctagtccggttccttccccgtgccctaccctccctaccgaacgacgcctacccgttcggacgggggccaacgcggtcccggtcccgtcggggcctggccgtcggttacgaacggtacttacgttccgcgtaacgtcgcgtcgtagcggtccgggngtgg

SEQ ID NO: 355769 - DNA, 715 bp, Homo sapiens
  misc_feature: GZ8MTXP01EKL5R.45.78.H01.1.454.CMB.2.raw
  modified_base (396)..(396): a, c, t, g, unknown or other
  misc_feature (396)..(396): n is a, c, g, or t
  modified_base (425)..(425): a, c, t, g, unknown or other
  misc_feature (425)..(425): n is a, c, g, or t
  modified_base (546)..(546): a, c, t, g, unknown or other
  misc_feature (546)..(546): n is a, c, g, or t
  modified_base (647)..(647): a, c, t, g, unknown or other
  misc_feature (647)..(647): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctggaggtagaagaagccgtggggcctcagtgaaggtctcctgcaaggtcttcgtaggactacctaccttcgaccggtctaactatactaccgacgtggggtacgcgaaccgccgggtcccccgtaggggaaccgtaggggtctttagggaggtagggagttgggggattagggaactacccgaaaccctaaanaaggttgggtacgaccaaactaaaaactntcgacaaacgaggttaacgttcggacggggctaacggggtccaaacgtagtacggaaccggtaacgggaccctaaaccggtcaacgacgaacggacccaacgaaccggacccttaaagggngttaacgggacgcggtaagacggacgaagggccgttagaacggtacttaccggaggaaccggtacccggttacggggtaccgtttagtacgtttaaccggngggttacgacgggtaaggacggtaacgttaacggttaagttttacgggtttaaggtttaagggtaagg

SEQ ID NO: 355770 - DNA, 767 bp, Homo sapiens
  misc_feature: GZ8MTXP01D05QG.45.78.H01.1.454.CMB.2.raw
  modified_base (317)..(317): a, c, t, g, unknown or other
  misc_feature (317)..(317): n is a, c, g, or t
  modified_base (324)..(324): a, c, t, g, unknown or other
  misc_feature (324)..(324): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcaacagtaagtttcagggcagggtcaccatcgaccaggacacgtcatcagcacagcctacagtggagctgagcgagctagagatcagacgacacggcgtagtattagttgngcggagnggtacgtaaggtaactttaggtaagttttgggagttagggtttattacggggtaaacgggttatcggggaccgttcgggtacgggggacccgtaaacggggccccgtaacgggttcccgtacccggttcctaccgttccgaccgtccccgtaacccgaacccggtaaaccgggccccgtaacggttccccggttaccccttccccccggtacgggaccccctacccccttacccgtacccgaaacgacccgtcccggtaaccccgtttccgggccgggggaacccaaccggtccggggccccggggtccccggttcgggggaacccctttcggggttccccggtcggggtttaaccgaaaccggggttacccttaccccgtttccgaaccggtcgttccggtccgttacggtcgggaccgggtcccgggttgtaacccggggg

SEQ ID NO: 355771 - DNA, 633 bp, Homo sapiens
  misc_feature: GZ8MTXP01B7JPI.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatcgtagacgacgacggccgtagtacttacgtgtgcgagaggcaggtaattacgtagtttttgggagttggttagtcggtaacggttagtgggacgtcggtcggggaccgaacggggaccgtacgggtcctacccgtctaccgtcacgtccctacccaacccgacgggccctacgtccgtcccttaccccgtcggcccctaccccgtccctaccgaacgccgaccctcccgtcggtcgggggccacgaccgggcccggtcccgtgggctcggccggtcggttccgaacggtccttaccgttcccgttacgcgtcccgcgttcgcgggacggtccgggcgtaacggg

SEQ ID NO: 355772 - DNA, 606 bp, Homo sapiens
  misc_feature: GZ8MTXP01CQP7Q.45.78.H01.1.454.CMB.2.raw
  modified_base (387)..(387): a, c, t, g, unknown or other
  misc_feature (387)..(387): n is a, c, g, or t
  modified_base (485)..(485): a, c, t, g, unknown or other
  misc_feature (485)..(485): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtgggcctcagtgaaggtctccgtgacaaggtcttcgtggactacaccttcaccggctactatactacgacgtgggtgacgacgacggcccctagggaacgaagggtcttggagtgggagtggggatggataccaaacctaacgaagtggtcggacaacgtaaaaactntcgactaagaagtacgttcgagggacagggtccaacgagtacgaccgaggaaccacggtaccatacgacgacaacgacgtaccctagacgtgggaacncgtagacgccgaggtcgtgaagtacgtcgacggaacgacgaccggtccgttgttaaacgtcgttggttcgacggaaggacggaacgtaagggttattacggtttaagttttgggttaaggg

SEQ ID NO: 355773 - DNA, 578 bp, Homo sapiens
  misc_feature: GZ8MTXP01BVJ1K.45.78.H01.1.454.CMB.2.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
  modified_base (432)..(432): a, c, t, g, unknown or other
  misc_feature (432)..(432): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagctgggcctnagtgaagtctctgcaaggctnggatacaccttcaccggctactatatacacgtgggtgcgacgacggcccctgggaccaaggggcttaggacggtggagtggggatggactacaaaccctaacaagtggtaggacaacaaaacttatgacaacgaaggtaacgtttcgaggggcacgggtacacgagtacgacgacggacacgtctancgacgacacgacgacctacgagtggagcgtagacgcgaaggcgtaggagtacgtacgtcggaacgacgttacgggccgttaggtacttaccggagttcggacgaaggacggccgtaaggtacgttacggttaagttttgggtaagg

SEQ ID NO: 355774 - DNA, 656 bp, Homo sapiens
  misc_feature: GZ8MTXP01EH1IN.45.78.H01.1.454.CMB.2.raw
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (269)..(269): a, c, t, g, unknown or other
  misc_feature (269)..(269): n is a, c, g, or t
  modified_base (493)..(493): a, c, t, g, unknown or other
  misc_feature (493)..(493): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagcgtgggctcgagtgagtctctgcaggcttngatacactcacgntactanatacncgtgggncgacgacggccccgtaggacgaagggtcttggagtgggagtagggggtatgggaactacctaaaccctaaacgtaaagtggggtacggacccaaaccgtaaaatacgtagaccaaaacgtaaggtaacggtttcggaacggggtcgacggggtaccaaccgtagaccggaccgaagggactaccggtacagtacaacgacaacgacgtacctagagtaggacgnggtacgacggtcgacggtacgtagagtacgtacgtacggtaccgaccggtaccggtccgttaagttacttcggtaggacggacggtaaggaggttacgttaaagggttaacgtttaggtttaaggtttagggtaggtttcgggtttaacggttcggggtaagg

SEQ ID NO: 355775 - DNA, 644 bp, Homo sapiens
  misc_feature: GZ8MTXP01B44CW.45.78.H01.1.454.CMB.2.raw
  modified_base (226)..(226): a, c, t, g, unknown or other
  misc_feature (226)..(226): n is a, c, g, or t
  modified_base (292)..(292): a, c, t, g, unknown or other
  misc_feature (292)..(292): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagcctggggcctnagtgaaggtctctgcaaggcttctggatacaccttcaccggctactatatacacgtgggtgcgacncggcccctggacgaagggcttgaggtggagtgggatggactcaaaccctaacaagtggtaggaccaaacgtaaaaaactagtcgacaaagtaagtaaacggttttcgaacgggggacaacggggtaccaaccgtagtacggaaccgaacggggaacgtaccggtacctaagtcgaacggacaacgacggtacccttaacggaggttaacgggagaccgtagaacggccgtaggaccgtagacggtacgtacgttcggaacggtaccgacgggttaccgttagtttagtaacgttgttcggacggtaaggaggaacgtaaggtacgtttacggttaagtttttaagggtaagg

SEQ ID NO: 355776 - DNA, 615 bp, Homo sapiens
  misc_feature: GZ8MTXP01CH1GO.45.78.H01.1.454.CMB.2.raw
  modified_base (256)..(256): a, c, t, g, unknown or other
  misc_feature (256)..(256): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagccgtggggcctcgagtgaaggtctccgtgacgaggtcttgnggactactaccttcgaccggctaactatatacacgtgggtcgcgacacggcccctagggacgaagggctggagtgggagtgggatggactaccaaacctaacgagtggagacaacaaaactatgacaacgaggtacgttacggacgggtacgacggtaccaacgtacgacgaaccggaaggaccgtaccgtacacgtacgacgaccaacgaccgtaccctaagaggtacggacgtacgtacggacgcggacgtaccgagacgtacgtcgaacggaaccgtcggacggttccgttagttaacgtgttggcggacgtaagggaacgtaacgtaagttagttagtttaagtttgggttaagg

SEQ ID NO: 355777 - DNA, 551 bp, Homo sapiens
  misc_feature: GZ8MTXP01ACB55.45.78.H01.1.454.CMB.2.raw
  modified_base (462)..(462): a, c, t, g, unknown or other
  misc_feature (462)..(462): n is a, c, g, or t
  modified_base (519)..(519): a, c, t, g, unknown or other
  misc_feature (519)..(519): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctgagtgaaggtctcctgcaggcttctggatacaccttcaccggctactatatacacgtgggtgcgacgacggcccctggaccgaagggtcttggagtggagtggggatggatacaaaccctaacagtggtaggacaacaaaacttatgacaacgaggtaacgtttcgaggggcaacgggtaccaccgagtacgaccgagggacacggtccagtcagacacgagccctaggatggancgtgagcgaggcgtagagactcgagcgacgcggccgttgtaactgagttcgagaagngtaacgaggtattacggttgtttaaggtaagg

SEQ ID NO: 355778 - DNA, 572 bp, Homo sapiens
  misc_feature: GZ8MTXP01DLXXN.45.78.H01.1.454.CMB.2.raw
  modified_base (280)..(280): a, c, t, g, unknown or other
  misc_feature (280)..(280): n is a, c, g, or t
  modified_base (499)..(499): a, c, t, g, unknown or other
  misc_feature (499)..(499): n is a, c, g, or t
  modified_base (558)..(558): a, c, t, g, unknown or other
  misc_feature (558)..(558): n is a, c, g, or t
tcagacgcgatcgacacgaccggtgctcgatttagtgtgagtagtttggggttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtgcacaactatgcacagagtttcaggcaggtcaccatgaccaggacacgtccatcagcacagcctacatggagctgagcagctgagntctgacgacacggccgtagtattactgtgcggagaggcaggaatttacgtagtttttggagttggttattcggaacggtgtggtacgtcgtcggggcaaggggccacggttcacccgtctcctcacgcctcgacccgaacgggtcccagtccgggtcccttcccccgtggtaccccaccccggttctacccgacgacgcccgacctccggtggggaccncgacggccgcccgtgggctcgaccgtgttacacggtacttcgttccttcgctcgcgtcnggcgtcggcgtcgg

SEQ ID NO: 355779 - DNA, 677 bp, Homo sapiens
  misc_feature: GZ8MTXP01EF905.45.78.H01.1.454.CMB.2.raw
  modified_base (188)..(188): a, c, t, g, unknown or other
  misc_feature (188)..(188): n is a, c, g, or t
  modified_base (622)..(622): a, c, t, g, unknown or other
  misc_feature (622)..(622): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaanaatggtggcacaaactatgcacagaagtttcagggcagggtcaccatgaccagggacacgtccatcagcacagcctacatggagctgagcaggctgagatcgtagaccgacgacggtccgtagtacttacgtgtgcgaggagcgaaggtaattacgtagttttggagttaggttacgttcgggtaaacggttgtgggacgtcggtacggggaccgaacgggaccgacggtaccgacccgtctcctacgacgtccctaccgaacccgaacggggtcccctaacggttcccgttccccttcccccgtaggtaccccctaccccgttaccccaccggaaacgacgtcccgaacccgtcgggtacggggaccaccgtaggcccggtcccgtcggggcttcggccgtgggttaccgtaaccggtcttacccggtttccncgttaacgttccggtcccgtttcgacgggacggtcccggggttaacgtccggggg

SEQ ID NO: 355780 - DNA, 619 bp, Homo sapiens
  misc_feature: GZ8MTXP01DG0V8.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagctgagatcagacgacacggccgtgtattactgtgcgagagcaggtattacgtagttttggagttggttatcggaacggttatgggtacgtcgtcggggaccaagggccacgggtcaccgtcgtcctcgacgcctaccaccgaacggcccacgtccggtcccttcccccgttggacccctacccggtccctcccaaacgaccgaccgtaccgtccggtcggggaccacggaccggccggtcccgtgggccgtcggcccgtcgggttaccgaaacgggtaccttacccgttcccgttcgtaacgtcggtcgttccggcggacgggtccgggttcggtcgg

SEQ ID NO: 355781 - DNA, 696 bp, Homo sapiens
  misc_feature: GZ8MTXP01BBA41.45.78.H01.1.454.CMB.2.raw
  modified_base (366)..(366): a, c, t, g, unknown or other
  misc_feature (366)..(366): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcgagtcgtggggctggaggtgaagaacgccgtggggcctcgagtgaagtctcctgacaaggtcttcgtggactaccgaccttcgacccgtctaactatatacacgtgggtcgacgacgacggccccgtaggacaagggtctggaggtggagtggggatggactacaaccctaanaagtgggtacgacaacgtaaaaactacgtgaccaacgtaaaggttaacgtttacggaggggcgtaacgggtcccaacgtaagtaccggaaaccggaagggacccgtaccggtaccctaagtacccgaacgaccctaacctaacgggaccccttaacggaggttacggggactacccgtaggacggaccgtaggtaccgtaggaacgtactaccgaggaaacccgacggttaccggtaccggttagttaaccgttgttcgggttggaccgggaagggttccggaacgtaaagggttacggtttacgggtttaagtttttgggggtaaccgg

SEQ ID NO: 355782 - DNA, 613 bp, Homo sapiens
  misc_feature: GZ8MTXP01AX170.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctggaggtgaagaagccgtggggcctcgagtgaaggtctccgtgcaaggtcttcgtggactacaccttcaccggtctactatatacacgtgggtcgcgacgacggcccctaggacaaggggtcttggagtgggagtgggtatggaactaccgaaacccgtaaagagttggtacggaccaacgaaaaactatcgacaacgagtaacgtttcgaagggcgaggtcacatacgacgagggacacgtacatcagcactacgaccgtacgagtggagcgtaggaagcgaaggcgtaggaacgtactcgtaaggaacgacggttaccggtaccgttagggttattccggttaggttccgggagaacgggacgtaaggtaaacgggtacgtttaacggtttaaggttttaagggtaagg

SEQ ID NO: 355783 - DNA, 639 bp, Homo sapiens
  misc_feature: GZ8MTXP01AVKS7.45.78.H01.1.454.CMB.2.raw
  modified_base (555)..(555): a, c, t, g, unknown or other
  misc_feature (555)..(555): n is a, c, g, or t
  modified_base (597)..(597): a, c, t, g, unknown or other
  misc_feature (597)..(597): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtagaagacgccgtgggcctcgagtgaggtctcctgacgaaggtcttcgtaggactacctaccttcgaccggtactactatactaccagtgggtcgccgaacgccggtccccctaggaacgtaagggtcgtttaggacggtgggacgttaggggacgttagggaacctaccgtaaaacccctaacggtaaaggtttcgggtacggaccctaaacgaaaaaacttctaacggacaaacgtaagtacgtttacgaggggtacgtacgggaccaaccgtagacgaaccgagggtaccacgtacgatcagaccacgtacgacctagagtgggaactgacgagcgacgtangagtactcgagaacgacgaacggtcgttagtacgtagttggngacggaaggcgaagtaaggttagttagttaagtttggtaagg

SEQ ID NO: 355784 - DNA, 553 bp, Homo sapiens
  misc_feature: GZ8MTXP01BDOOR.45.78.H01.1.454.CMB.2.raw
  modified_base (225)..(225): a, c, t, g, unknown or other
  misc_feature (225)..(225): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctnagtgaaggtctctgcaaggcttctggatacaccttcaccggctactatatacactgggtgcgacacggcccctggacaagggcttggagtggatgggatggatacgaaccctaacaagtggtaggacaacaaaaacgtatggacaacagtaacgtttcgagggtcagggtcacgatcgacgagggacacgtcatcagcacagaccctagagtggagcgtagagcgaggctagagtatcgtacggaacgacacgggtccgttagtagttaacgttggttcgacggaaggaggaacgtaagggtattacggttaagtttttgggtaaggg

SEQ ID NO: 355785 - DNA, 582 bp, Homo sapiens
  misc_feature: GZ8MTXP01CAP1F.45.78.H01.1.454.CMB.2.raw
  modified_base (227)..(227): a, c, t, g, unknown or other
  misc_feature (227)..(227): n is a, c, g, or t
  modified_base (240)..(240): a, c, t, g, unknown or other
  misc_feature (240)..(240): n is a, c, g, or t
  modified_base (253)..(253): a, c, t, g, unknown or other
  misc_feature (253)..(253): n is a, c, g, or t
  modified_base (292)..(292): a, c, t, g, unknown or other
  misc_feature (292)..(292): n is a, c, g, or t
  modified_base (297)..(297): a, c, t, g, unknown or other
  misc_feature (297)..(297): n is a, c, g, or t
  modified_base (324)..(324): a, c, t, g, unknown or other
  misc_feature (324)..(324): n is a, c, g, or t
  modified_base (458)..(458): a, c, t, g, unknown or other
  misc_feature (458)..(458): n is a, c, g, or t
  modified_base (467)..(467): a, c, t, g, unknown or other
  misc_feature (467)..(467): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctnagtgaaggtctcngacaggtcttcgnggatacgaccttcaccggctactatatacacgtgggtcncgacncggcccctggacaagggcttgagtggntggatggatcaaaccgtaacagtggtcgacaacgtaaaaactgtcgacaacaaggttaacggttcgaacggggcaacgggtcaaccgtagacggaccgagggtaccacgtacactcagacacgagtaccctagngtaggacgngaggacgcgtacggtacagacgtacgtacgacggaaccgaacgcggtacgttagtaacgtgttcggcgaaggtaaggacgtaagtaaggttacgtttacgttaaggtttggtaag

SEQ ID NO: 355786 - DNA, 699 bp, Homo sapiens
  misc_feature: GZ8MTXP01BGA6M.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagaagtttcgagggcagggtcaccatgaccgagggacacgtccatcagcacagcctacagtggagctgacgcgaggctgagtatcgtaggaccgacgacggtccgtagttactttacgtggtgcggaggaggacgaaggtaattacgtagtttttggagttggttagttcggaacggttagtgggacgtcgggtacggggaccgaacggggaccgtacgggtccaccgtcctccgtcacgcccgtaccaacccggacgggtcccctacggttcccgttcccttcccccgtacggcccctaccccggttccctacccgaacggacgacccgtacccgtcggtcgggggacccaacgtccgggcccggtcccggtgggccctcggcccgttacgggttaccgtaaaacgggtccctttaacccgttcccgttcggtaaccgtttccgggcccgtttcggcggggttacgggccggggttaaccgtcgggg

SEQ ID NO: 355787 - DNA, 578 bp, Homo sapiens
  misc_feature: GZ8MTXP01DX9K6.45.78.H01.1.454.CMB.2.raw
  modified_base (416)..(416): a, c, t, g, unknown or other
  misc_feature (416)..(416): n is a, c, g, or t
  modified_base (507)..(507): a, c, t, g, unknown or other
  misc_feature (507)..(507): n is a, c, g, or t
tcagacgcgatcgacacgaccggtgctcgatttagtgtgagtagtttggggttggggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagtttcagggcagggtcaccatgaccagggacacgtccatcagcacagcctacatggagctgagcaggctgagatctagacgacgacggccgtagtattacgtgtgcgagtaggcaaggtaattacgtagttttggagtggtttatcgggtaacggtatgggacgtcgtaggggccaaggggaccacggtcaccgtctccgtcncgcctccaaccacgggcccacgtccgtcctcccctgccacccgtcctaccacgtaccgcacccgtcgtcgggggacacgaggtcccgccgngggcttcgcccgtgttacgacggtacttccgttccttcgtaactccgcgtcgtcgacggtcgggcgtcggg

SEQ ID NO: 355788 - DNA, 664 bp, Homo sapiens
  misc_feature: GZ8MTXP01CD8ZU.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaaccctaacaatggtggcaacaaactatgcacagtaagtttcagggcagggtcaccatgaccaggacacgtccatcagcacagcctacagtggagctgagcgaggctgagatcgaggacgacgacggccgtagttacttacgtggtagcggaggaggacgaaggtaattacggttagttttgggaggttggtttagttcgggtaaagggttagtgggtacgtcgggacggggaccgaacggggacccgacggtccacccgtctcccgtacgacgtccctaccgaacccgacgggtccctacgtcccggtacccttccccgtcgtcccctacccgtccctaccgaacgaccgccgtacccgtcggcggggacccacgtaccgggcccggtcccgtggggccctcggccgttacggaccgtaaacgggtccttaccgttcccttacgtcgtccgtcgttcggcggagggcccggttcggtaacggg

SEQ ID NO: 355789 - DNA, 572 bp, Homo sapiens
  misc_feature: GZ8MTXP01EZKSE.45.78.H01.1.454.CMB.2.raw
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
  modified_base (291)..(291): a, c, t, g, unknown or other
  misc_feature (291)..(291): n is a, c, g, or t
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (499)..(499): a, c, t, g, unknown or other
  misc_feature (499)..(499): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcgagcgtgagntcngacgacacggcgtgtatactggngngagagnagtaatagtatttaggagtgtagtcggaagtgnggtacgtcggngggacgaacgggaccgacggtcacgtctcctcgacgcctaccgaacgacggcctacgtccgtccctcccgtcgaccacccgtctaccgaacgacgcctaccgtcggtcgggaccgacgtacggcccggtccgngggctcgccgtacggttacgaacggtaccttaccgttccgttcgtcgtcgtcgtcgtcggacggtcggcgtcg

SEQ ID NO: 355790 - DNA, 772 bp, Homo sapiens
  misc_feature: GZ8MTXP01C07O3.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtagaagaagccgtggggcctcgagtgaaggtctctgcaggtctctggactacacttcgaccggtactactatactactacgtgggtcgacgaccgaccgggtcccccgtagggaaccggtaaggggtcgttaggaggtggggagtgggggagtaggactacctaaaccctaacgtaaggtggggtacggaaccaaacgtaaaaaccttataacggacctaaacgtaaacggttaacggttaccggaggggtaccgaacggggtaccctaaccgtaaggtaccgggaaacccgaacggggaaccctaaccggttaccaacgtaccgaacggacccaaaccgtaccgtaaccccttaaacggggaacggttaggggtaaccgaccggtaagggaaaccggtccggaaagggtacccgtaaagggaacgttaaccgtaccgtaacggggaaccgtaaccgggttacccgggtacgttacggttaaactccgggttagggttcgacgggtaagggacggtaacgttaacgggttagtttacgggtttaagttttgggggttaacgg

SEQ ID NO: 355791 - DNA, 666 bp, Homo sapiens
  misc_feature: GZ8MTXP01A249C.45.78.H01.1.454.CMB.2.raw
  modified_base (271)..(271): a, c, t, g, unknown or other
  misc_feature (271)..(271): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagacgtcaccatcacttggccggcagtcagagtatagtactggtgctgtatcagcaagaaaccgaggaaacnccctaaagcctactgctactaatacggctattacgtaagttttaaggaaacggttcgggggtacccaagttacgtaaagggttcaggcccggtacgaggtcggaatccgtaagggaacaagtactttccgactctaccaaccatccaagccgaacgtcccgtagacccaaggtccctagtaattcgtaattttcgaacttaaacctttaggttaactcggtaaaccctaagtaagtaagttagtaattacgggtttaaacttacgggtaacccggttaccggggaaccgtaaaaggggtaaccctaaaagggggttcggtaaaacttaccgaaaacgtaacgttcggttacgggactaacggacctaaccgtattccttacgttccttaacgtcc

SEQ ID NO: 355792 - DNA, 713 bp, Homo sapiens
  misc_feature: GZ8MTXP01CFY5H.45.78.H01.1.454.CMB.2.raw
  modified_base (272)..(272): a, c, t, g, unknown or other
  misc_feature (272)..(272): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtcatcagcacagcctacagtgganctgagcgaggctggagatcgtgacgacgcggcgttgtattacgtggtgcgaggaggactaaggtaattacgttagtttttgggagtttaggtttacgttccggggaaacgggtttagtcggggtaccgttcggggtacggggacccgtaaacggggacccgtaaccgggtccctacccggtttcctccccgttcgacccggtccctacccgaacccggaaccgggccctacggtcccggttcccttaccccccggtcggaccccctaccccggtccctaccgaacggtaccgcccgtaacccgtcgggtaccgggggacctaccggaccggcccgggccccgtcgggccgtcggttcccggtcggttaaccgtaacggtccttacccgttccgttccgtaacgtcccggtcgtcgtgggacgggccgggttcgtaaccggg

SEQ ID NO: 355793 - DNA, 702 bp, Homo sapiens
  misc_feature: GZ8MTXP01BZVL5.45.78.H01.1.454.CMB.2.raw
  modified_base (188)..(188): a, c, t, g, unknown or other
  misc_feature (188)..(188): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaanaatggtggcacaaactatgcacagtaagtttcagggcagggtcaccatgaccagggacacgtcatcagcacagcctacatggagctgagcgaggctgagatctagacgacacggccgtgtattactgtgacggaggaggcgaaggtaattacgttagtttttgggagttggtttagttacgggtaacgttagtcgggacgtcggtcgggggaccgaaaggggtacccgacgggtccctacccggttcctacccgttaccgaccgtaccccttacccgaaacccggtaaccggggtcccctacggttcccgggttccccttcccccgtcggacccctacccccgttccctacccgaaacgccgtacccgtaacccgttcgggaccgggggacctaaccgtccggggcccggtccccggtggggccctcggttccggttacggttaccgaaaccggttcctttacccgttccgttcgaacgtccggtcgttcgagggccggtcgggcgtaacgggg

SEQ ID NO: 355794 - DNA, 647 bp, Homo sapiens
  misc_feature: GZ8MTXP01AN8LH.45.78.H01.1.454.CMB.2.raw
  modified_base (254)..(254): a, c, t, g, unknown or other
  misc_feature (254)..(254): n is a, c, g, or t
  modified_base (583)..(583): a, c, t, g, unknown or other
  misc_feature (583)..(583): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtctggggctgaggtgaagagccgtggggcctgagtgaaggtctccgtgcaaggcttcgnggtactacaccttcaccggtctactatatacacgtggtcgcgacgacggcccctaggaaccgtaagggtctttaggaggtggacgtggggattggaactaccgaaacccctaagaacggttggacggacctaaacgaaaaactagtcgacaacgtaaggtacgtttcggaagggtcaacgggtaccaacgagcgaaccgagggacaccgtaccagtccaagccaacgtcgaccctaggaagtcggagacgtcggaacgccgagggtcctaggagttacgaccgttcggaaccgaccgttaacgggtcccgttagttacgtttaacgggnggttacggacggaacggtacggaacggtaaggttaacgtttacggtttaagtttaagggtaacg

SEQ ID NO: 355795 - DNA, 727 bp, Homo sapiens
  misc_feature: GZ8MTXP01DILHQ.45.78.H01.1.454.CMB.2.raw
  modified_base (291)..(291): a, c, t, g, unknown or other
  misc_feature (291)..(291): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagccacagcctacatggagctgagcaggctgagatcngacgacacggccgtgctattactggtgacgtaggaggacgaggtaaactttaccgtagtttttaggagtttggttagttacgggtaacggttaagtcgggtacgtcggtacgggggaccgaaacggggacccgtacgggttccctaacccggttcctcccgtaccgacggtcccctacccgaacccgaaaccggggtcccctaacgttccccgggttccccttacccccgtcgggccccttaaacccccgttcccgttacccgaaacggtaccgccctaacccgttccgggtccgggggacctaaccggtaccgggcccgggtccccggtggggtcccttcgggtacccgttgggttaccgaaaccggggttcctttaccggtttacccgtaacgtacgttccgggtccgttccggttggtaacgggcgggtccgg

SEQ ID NO: 355796 - DNA, 629 bp, Homo sapiens
  misc_feature: GZ8MTXP01BK6BP.45.78.H01.1.454.CMB.2.raw
  modified_base (357)..(357): a, c, t, g, unknown or other
  misc_feature (357)..(357): n is a, c, g, or t
  modified_base (489)..(489): a, c, t, g, unknown or other
  misc_feature (489)..(489): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagagccgtggggcctcgagtgaaggtctcctgcaaggtcttcgtggactacaccttcaccggctaactataatacacgtggtgacgacgacggcccctaggacgaagggcttgaggtggagtgggataggactacgaaacccttaanaagtggtacggacaaactaaaaactatcgacaaacgtagtaaacgtttacgacggggacgaacgggtacaaccgaagtacgaaccgaacgggacaacgtacactacgacgacaacagaccctagagtggacncgtagagcgaggacgtgaagtacgtcgaaggaaccgaaccgacgggtaccgttagttaacgttacgttaggttcggaaccggtaaggaagggtaacgtaagggttaacgtttaacggtttgttttaaggggttaaccggg

SEQ ID NO: 355797 - DNA, 618 bp, Homo sapiens
  misc_feature: GZ8MTXP01BUDKT.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagccctacatggagctggagcgaggctgaggactcgtgacgacaccggccgtagtattactgtgcgaggagcagggtaattacgtagtttttggagttggttagttcgggaacggtagtcgggacgttcgcgggggtaccaaggggaccacgggtccaccgtctcctcgacgcctaccgacccgacgggccctacgtccggttcccttcccctggcccacccggtccctccgaacgcgtacccaccctcggcggggccaccgcggccggtcccgtggccttgacccgtggttaccgaggtacccttacgttcccgttacgtcgtcggccgttcgtcgggcgggtcccgggttcgtcggg

SEQ ID NO: 355798 - DNA, 652 bp, Homo sapiens
  misc_feature: GZ8MTXP01AMKLV.45.78.H01.1.454.CMB.2.raw
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
  modified_base (552)..(552): a, c, t, g, unknown or other
  misc_feature (552)..(552): n is a, c, g, or t
  modified_base (579)..(579): a, c, t, g, unknown or other
  misc_feature (579)..(579): n is a, c, g, or t
  modified_base (619)..(619): a, c, t, g, unknown or other
  misc_feature (619)..(619): n is a, c, g, or t
  modified_base (633)..(633): a, c, t, g, unknown or other
  misc_feature (633)..(633): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtgcaacaaactatgcacagaagtttcgaggcagggtcaccatcgaccagggacacgtcatcagcacagcctangtggancgtgagcgaggcgtagacgactcgtacggaccgaccgacggtccgtagttattacgtggtcggacgtaggacggtacgtaaggtagttacgttagttttggagttaggttagtacgggtaacgtagtcggacgtcggacggggtaccgaacgggaccgacggtacctacccgtccgttccacgaccgtacccacccgaccgacggtacccctacgtcccgttacccctccccggttacgccctaccccgtctacccgaaacgccgaccctacggtccggngggggacccaacgtcggcccggtccgngggtctacggcgtacgcgtaaccggtctttacgttcccgngtctcggcgttcgnggttacggccgttaagccg

SEQ ID NO: 355799 - DNA, 734 bp, Homo sapiens
  misc_feature: GZ8MTXP01AF4OQ.45.78.H01.1.454.CMB.2.raw
  modified_base (716)..(716): a, c, t, g, unknown or other
  misc_feature (716)..(716): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtgcacaaactatgcacagtaagtttcagggcagggtcaccatgaccagggacacgtcatcagcacagcctacagtggagctgagcgagcgtgagctcgagacgacgacggctagtattacgtgtgacggaggacggtacgaaggttaaattacggtttaagtttttaggggaggtttcgggtttaacgttacggggtaaaccgggttagttcggggaaccggttcgggtacggggggaaccccgtaaacgggggtaccccgtaacggggtaccctacccgggttaccttcccgttacgaacccggcccctacccgaacccgaacccggggtcccctaacggttccccgggttccccttaccccccgtacgggaccccgtaccccttcccgtaacccgtaaacgcccggacccgtcccgttcgggccgggggaccaacggtccgggcccggggtcccgtcggggctcggccgtcgggttaccgaacgggtacccttccttccgacgtaacgtcggtcgtacggngggacggtcgggcgcggg

SEQ ID NO: 355800 - DNA, 526 bp, Homo sapiens
  misc_feature: GZ8MTXP01EC428.45.78.H01.1.454.CMB.2.raw
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
  modified_base (356)..(356): a, c, t, g, unknown or other
  misc_feature (356)..(356): n is a, c, g, or t
  modified_base (427)..(427): a, c, t, g, unknown or other
  misc_feature (427)..(427): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagctggggcctnagtgaggtctctgcaggcttcnggatacacttcaccggctactatatacacgtgggtgcgacgacggcccctggacaagggcttgagtggatgggatggatacaacctaacaatggtgacacaaaactangcaacgagaagtttcgagggcagggtacacatcgacaggacacgtccatcagcacacgacctacgatggancgtgagcgagctaggagtatcgtagaacgaacgttcggacgttgtacgttaagttggttgcgaaggaggaacgaggtagttagttaagtttggttaagg

SEQ ID NO: 355801 - DNA, 634 bp, Homo sapiens
  misc_feature: GZ8MTXP01C04N7.45.78.H01.1.454.CMB.2.raw
  modified_base (263)..(263): a, c, t, g, unknown or other
  misc_feature (263)..(263): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctggaggtagaagaagccgtggggcctcgaggtgaacggtctccgtgacgaaggtcttcgnggactacctaccttcgaccggtctactatatacacgtggtgcgacgacggccccgtaggaaccgaagggtcttaggaggtgggagtggggataggaactaccaaaccgtaacaagtggtacgacaaccgaaaaaactgtcgactaacgaaggtaacgtttcgacggggtacgacgggtccaacgagtacgacgaaggaccacgtcatcgaacgcaacacgtacctaacggagtacgggacgtcgtaggacgcgaggctaggacgtagtcgacggaacgacgacgggtccgttagttaacgtcgttggttcgacggtaacgggaacggtaacgtaaagggtaacgtttagggtttaagttttggggtaaggg

SEQ ID NO: 355802 - DNA, 643 bp, Homo sapiens
  misc_feature: GZ8MTXP01BGMIB.45.78.H01.1.454.CMB.2.raw
  modified_base (243)..(243): a, c, t, g, unknown or other
  misc_feature (243)..(243): n is a, c, g, or t
  modified_base (554)..(554): a, c, t, g, unknown or other
  misc_feature (554)..(554): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcgaggtcgtggggctggaggtagaagagccgtgggcctgagtgaggtctcngcaggtcttcgtgactactaccttcgaccgtctactatactacgtacgtgggtcgaccgacgaccgggccccgtagggaacgtacgggggtcttggaggtgggacggtggggactaggaactaccgtaaaccccgtaaacgtaaggttggggtacgacctaaactaaaaacgttactcgacaaacgtaaggttaacggttcggacggggacgtacgggtacacgtagtaccggaaccgacggaccgtaccgtacctacgacgacgacaacgacgtaccctaggagtacgggctacgaggagcggagtacgngtacgtatcgaggaacgacgcgggtcttagtacttacggttgcggacgaaggacggtaagtaaggtagttacgtaaggttttggtaagg

SEQ ID NO: 355803 - DNA, 759 bp, Homo sapiens
  misc_feature: GZ8MTXP01D4PTD.45.78.H01.1.454.CMB.2.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (697)..(697): a, c, t, g, unknown or other
  misc_feature (697)..(697): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccgaggtgcagctggtgcagtcgtgggctgaggtgaagagccgtgggcctnagtgagtctctgacagctntgatacacctcaccggctactatactacgacgtgggtgaccgacgacggccccgtagggaaccgaagggtccgttagggaggtgggtaaggtgggggtaattacgggaaactaacccgtaaaacccccgtaaagtaaacggttcggggtacggaaccctaaacctaaaaaaaaccgttagtaacggaaccaaaccgtaaagggttaaaacggttttcggaacgggggtaccgtaaacggggtacccaaacccgtaagtaccgggaaacccggtaacggggaaaccctaacccggtaaccgtaactaccgaaccgaacctaaacccgacgtacccctaaacgggtaggttacgggaaaggttccgaaggtaacggaccggagggaccgtaggaacgtacgtacccgtagggaaacccggtacgaaccgggttccgttaagttacgtttacgngggttcgacggtaagggacggtaagtaaagggtacgtttaggttggtttttaagggtaaggg

SEQ ID NO: 355804 - DNA, 394 bp, Homo sapiens
  misc_feature: GZ8MTXP01EMGT9.45.78.H01.1.454.CMB.2.raw
  modified_base (255)..(255): a, c, t, g, unknown or other
  misc_feature (255)..(255): n is a, c, g, or t
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
  modified_base (284)..(284): a, c, t, g, unknown or other
  misc_feature (284)..(284): n is a, c, g, or t
  modified_base (317)..(317): a, c, t, g, unknown or other
  misc_feature (317)..(317): n is a, c, g, or t
  modified_base (320)..(320): a, c, t, g, unknown or other
  misc_feature (320)..(320): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacacggcccctggacaagggcttgagtggatgggatggatcaaccctaacaatggtggcacaaactatgcacagaagtttcagggcagggtcaccatgaccaggacacgtccatcanggcaccancctacgatgagcngagcgagngtgagagcacgacgacgacgtcgtgtatactgngcnggacgaggatagattagtaatttggtgtgtagtacggtcgtagtcgagtctgggcgacggcacgcncgtctcnc

SEQ ID NO: 355805 - DNA, 640 bp, Homo sapiens
  misc_feature: GZ8MTXP01BXZ15.45.78.H01.1.454.CMB.2.raw
  modified_base (182)..(182): a, c, t, g, unknown or other
  misc_feature (182)..(182): n is a, c, g, or t
  modified_base (243)..(243): a, c, t, g, unknown or other
  misc_feature (243)..(243): n is a, c, g, or t
  modified_base (442)..(442): a, c, t, g, unknown or other
  misc_feature (442)..(442): n is a, c, g, or t
  modified_base (469)..(469): a, c, t, g, unknown or other
  misc_feature (469)..(469): n is a, c, g, or t
  modified_base (515)..(515): a, c, t, g, unknown or other
  misc_feature (515)..(515): n is a, c, g, or t
  modified_base (523)..(523): a, c, t, g, unknown or other
  misc_feature (523)..(523): n is a, c, g, or t
  modified_base (540)..(540): a, c, t, g, unknown or other
  misc_feature (540)..(540): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtncagctggtgcagtcgtggggctggaggtgaagagccgtggggcctcgagtgaaggtctcgngacaaggtcttcgtggactactaccttcaccggtctactataactacacgtgggtgccgaacgcggcccctagggaccgaagggtcttaggagtaggagtgggtatcggaattaccgaaacctaaacacgtaggtagaccaacgtaaaaactagtcgacaaacgtaacgtaagtttcgagggacgaggtaccaccgtanacggaaccgagggaacctacggtacanaccgagaccaacggacaccgtacgaagtggacaccgtgaacgccgngggtaccnggaacgtactacggaancccggaaacgcgggttccttagttaaaggttcgttagcgggaccgtaaggaccgttaaaggtgggttaaaacctttgggttaacgttttcgggttaaggg

SEQ ID NO: 355806 - DNA, 689 bp, Homo sapiens
  misc_feature: GZ8MTXP01AJ3K7.45.78.H01.1.454.CMB.2.raw
  modified_base (244)..(244): a, c, t, g, unknown or other
  misc_feature (244)..(244): n is a, c, g, or t
  modified_base (478)..(478): a, c, t, g, unknown or other
  misc_feature (478)..(478): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtgggcctcgagtgagtctcctgcaggcttcgnggatacaccttcgaccggtctactatatacacgtgggtgcgacgcggcccctggacgagggctttggacgtggagtgggatgggactaccgaaacccttaacaagtggtaggacccaacgaaactatcgacaaacgtaagtaacgtttcgaaggggtcgaggggtccaactagtacggaaccgaaggggaccctacggtacccagacgacgaccacacgtaccacagcggacgnggtggaacggcgacgggatacggacgtacgttacgtcggaacccggacgtaaccggggtccgtaaggtttaaacgttaaccggttggttacggtaccgggaaggttaaccggggttcggttaaaagggttaaaccgtttacgggtttaagggttttttaagggggtagggttttaaggggttttaaccgttaacggggggtttaaccgggg

SEQ ID NO: 355807 - DNA, 589 bp, Homo sapiens
  misc_feature: GZ8MTXP01EDHPO.45.78.H01.1.454.CMB.2.raw
  modified_base (136)..(136): a, c, t, g, unknown or other
  misc_feature (136)..(136): n is a, c, g, or t
  modified_base (220)..(220): a, c, t, g, unknown or other
  misc_feature (220)..(220): n is a, c, g, or t
  modified_base (243)..(243): a, c, t, g, unknown or other
  misc_feature (243)..(243): n is a, c, g, or t
  modified_base (264)..(264): a, c, t, g, unknown or other
  misc_feature (264)..(264): n is a, c, g, or t
  modified_base (277)..(277): a, c, t, g, unknown or other
  misc_feature (277)..(277): n is a, c, g, or t
  modified_base (530)..(530): a, c, t, g, unknown or other
  misc_feature (530)..(530): n is a, c, g, or t
  modified_base (543)..(543): a, c, t, g, unknown or other
  misc_feature (543)..(543): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctnttcttggtggcagcagccacaggagcccactcccaggtgcagctggtgcagtcgtggggctggaggtgaagagccgtgggcctnagtgaagtctctgcaaggcttcngatacacttcaccgctactanatacacgtgggtncgacacggccccgtggaacgaagggcttggagtggagtgggatggaataccaaacctaacgaagtcgggtagacccaactaaactagtacgacaaaacgagtaacggtttcgaagggtacgacgggtacaccgtagtacgaacgacgggacctacgtacgactacacgacacacgacctaacaagtagacgtcggtagacggacgaaggctaggaacgtacgtacgacgtacgacgtacgcgtaatacttagngttgcgaagcggngagtaagtttgtaagttttggaggttaggttaacgttcgggtaagg

SEQ ID NO: 355808 - DNA, 787 bp, Homo sapiens
  misc_feature: GZ8MTXP01CXTV2.45.78.H01.1.454.CMB.2.raw
  modified_base (188)..(188): a, c, t, g, unknown or other
  misc_feature (188)..(188): n is a, c, g, or t
  modified_base (266)..(266): a, c, t, g, unknown or other
  misc_feature (266)..(266): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaanaatggtggcaacaaactatgcacagaagtttcagggcaggtcaccatgaccaggacacgtccatcagcacagccctanatggagctgagcgaggctgaagatctagaacgacgacggccgttagttatacgtgtgacggagagacgaaggtaattacgttagttttggaggttggttagttaccgggtaagttagtcgggtacgtcgggtacgggggacccgaaaggggtaccccgtaaacggtcccgtaacccgttccgtcccgttacgaccgtccccgtacccgaaaccgaacccggggtacccctaaccggttcccggttccccgttcccccgtaccgggtacccctacccccgggtaccccttaccgaaaaccgtcccggaccctaacccggttcccggttaccgggggacccgtaaccggtcccgggtaccccgggcccgggttacggggtcccgtccgggttacccggttaccggggttaaccgtaaaccgggttcccctttaaacccgggttcccgttcccggttaaccgggttcccggttccggttaacccgggtcggggttaccggggtcccgggttaacggtaacgggg

SEQ ID NO: 355809 - DNA, 635 bp, Homo sapiens
  misc_feature: GZ8MTXP01D8WP5.45.78.H01.1.454.CMB.2.raw
  modified_base (228)..(228): a, c, t, g, unknown or other
  misc_feature (228)..(228): n is a, c, g, or t
  modified_base (253)..(253): a, c, t, g, unknown or other
  misc_feature (253)..(253): n is a, c, g, or t
  modified_base (296)..(296): a, c, t, g, unknown or other
  misc_feature (296)..(296): n is a, c, g, or t
  modified_base (472)..(472): a, c, t, g, unknown or other
  misc_feature (472)..(472): n is a, c, g, or t
  modified_base (573)..(573): a, c, t, g, unknown or other
  misc_feature (573)..(573): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagaagccgtgggcctnagtgaggtctctgcaaggtcttcgnggactacaccttcgaccggtctaactataatacgacgtgggtnccgaacacgggcccctaggacgaagggtcttggaggtggaagtcgggattggactaccgaaaccctaacgaaggtgggtacgacaaactaaaaactgtcgaactaacgtaaaggtaacgtttacggaaggggcgtagggtaccaacgtagtacgaacgtacgggactacgtctaancagcaacgacgaccctaagtagtacgggactacgtagagacgaggtaccgagtagtactcggcgaaaccgtacggaacggtccgttaagttacgttaacgngggttgaccggaagggaacggcgttaaggtaagtttacggttaaggttttaagggtaacggg

SEQ ID NO: 355810 - DNA, 576 bp, Homo sapiens
  misc_feature: GZ8MTXP01AXTQ4.45.78.H01.1.454.CMB.2.raw
  modified_base (224)..(224): a, c, t, g, unknown or other
  misc_feature (224)..(224): n is a, c, g, or t
  modified_base (279)..(279): a, c, t, g, unknown or other
  misc_feature (279)..(279): n is a, c, g, or t
  modified_base (449)..(449): a, c, t, g, unknown or other
  misc_feature (449)..(449): n is a, c, g, or t
  modified_base (465)..(465): a, c, t, g, unknown or other
  misc_feature (465)..(465): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagcgtgggctnagtgagtctctgcaggctgtgatacaccttcgaccgctactatatacacgtggtncgacacggcccctggacgaagggctaggagtggagtgggatggataccaaacctaacgaagtggtagacaacaaaaactatgacaacgagtaacgtttcgaggggcaacgggtacacgagtcgaaccgagggactacgtccatcgaagcacacgtccctaagagtggacncgtagacgcgaggtcngaacggtatccgagaaccggacgacccgggtacgttagtaagttacggttcggttggaccggaagggaggaaccgtaagggtaacgtttagggttaagttttgggtaaggg

SEQ ID NO: 355811 - DNA, 553 bp, Homo sapiens
  misc_feature: GZ8MTXP01CUK1L.45.78.H01.1.454.CMB.2.raw
  modified_base (272)..(272): a, c, t, g, unknown or other
  misc_feature (272)..(272): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (414)..(414): a, c, t, g, unknown or other
  misc_feature (414)..(414): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcgagcgtgaagctcagacgacacggccgtgtagtactgtcgcgagagcaggaattcgatttttggagtggttaatcggaaacgggtatgggaacgtgtaggggccaaggggccaacggtcacccgtncctacncgcnccacacgaccgacgcgtcgtccctccgccgacccgtccctccacgacgacgcctaccgtcggcgcgacgcgcccgtcggcgtcgccgtcgttcgacggtacgttacgttccttcgcgtcgcgtcgtcggcgtcggcgtg

SEQ ID NO: 355812 - DNA, 746 bp, Homo sapiens
  misc_feature: GZ8MTXP01E37XK.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctggaggtgaagagccgtgggcctgagtgaggtctcctgcaaggtcttcgaggactacaccttcgaccggtctaactatactacacgtgggtcacgacgacggccccgtagggaacgtaaggggtcttagggaggtagggtaagtagggggatagggaactaaccgaaaacccctaaacgaaggttcggacggaccaaacgtaaaaaacttagtcgaacaaacgtaaagggttaaacggtttcggaagggggtaccgtaacggggttacccaaaccgtaacggtaccgggaaacccggaaacgggggtaacctaacccggtaccaaacgtaccgaacggaccaaacgttaacgaccccgttaaacggggaggtacggggaaacgcggttacgggaacggccggaaagggttccgaggaacgtaactccggtaaggaacccgtacggttaaccgggtccgttagttaaacgttacggaggttccggacggaaggagggtaacgtaaagggttaactttagggttaacggttttaaggggtaaggg

SEQ ID NO: 355813 - DNA, 594 bp, Homo sapiens
  misc_feature: GZ8MTXP01A3LLL.45.78.H01.1.454.CMB.2.raw
  modified_base (253)..(253): a, c, t, g, unknown or other
  misc_feature (253)..(253): n is a, c, g, or t
  modified_base (374)..(374): a, c, t, g, unknown or other
  misc_feature (374)..(374): n is a, c, g, or t
  modified_base (444)..(444): a, c, t, g, unknown or other
  misc_feature (444)..(444): n is a, c, g, or t
  modified_base (553)..(553): a, c, t, g, unknown or other
  misc_feature (553)..(553): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgccagctggtgcagtcgtgggctggaggtgaagaagccgtggggcctgagtgaggtctctgcaaggcttgnggactacaccttcaccggctaactatactacacgtggtcgcgacacggccccgtggacgaggcttgaggtggagtgggattaggactaccaaacctaacagtggtacgacaacaaaacttngacacgaagtacgttcgaggggtacacgggtccaacgacgtacgaccgaacgggacctacggaccctaanacgacgaccaacgacgtaccctaaggacgtacgggacgtccgaggacgaccggagtaccgtagaacggtactacggacgtaacggaaccgcggtacgttcgttatacgngttcgagaagagaacgtagtagttagttaagtttggtaagg

SEQ ID NO: 355814 - DNA, 662 bp, Homo sapiens
  misc_feature: GZ8MTXP01AR9OA.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtggggcctcgagtgaggtctccgtgcaggtcttcgtggactaccgtaccttcgaccggtactactatactacacgtgggtgccgacgccgggccccctaggaaccgaaggggtcttaggaggtgggagtaggggatacggaactacccgaaaccgtaaccgaagtcgggtagaaccaactaaaaacctgtcgaccaaacgtaggtaacgtttcgaaggggtcgaacggggtaccaacgtagtacggaaccgacgggacctaccggtaccagtacgacgaccaacgaccgaccctacgagtacggacgcgtaggacgacgacggtactaggacgtacgttacggcggaaccgaaccggttaccggtccgttagttacgttcgttggttcggacggaaggacgtaacggtaaggtaacgtttagttaagtttttaagggtaaggg

SEQ ID NO: 355815 - DNA, 570 bp, Homo sapiens
  misc_feature: GZ8MTXP01E34FW.45.78.H01.1.454.CMB.2.raw
  modified_base (250)..(250): a, c, t, g, unknown or other
  misc_feature (250)..(250): n is a, c, g, or t
  modified_base (389)..(389): a, c, t, g, unknown or other
  misc_feature (389)..(389): n is a, c, g, or t
  modified_base (530)..(530): a, c, t, g, unknown or other
  misc_feature (530)..(530): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagagccgtgggctcgagtgaggtctcctgcaaggcttcgnggatacgtaccttcgaccggctactatactacacgtgggtagcgaacacggcccctgggaacaagggtcttggaggtggagtgggattaggactaccaaaccctaagaagtggtagacaactaaaaaactgtgaccaanaaggtaagtttcgaggggcagggtacaaccgatacgacgagggactaccgtcatcagcaacacgtccaacgagtaggacacgaggacgccgaggtacgtaggatacgtcgtacggaacgacgaccggcgttagtattacgngttgcgaaggacgtaagagtagttacgttgtttggtaagg

SEQ ID NO: 355816 - DNA, 655 bp, Homo sapiens
  misc_feature: GZ8MTXP01BWA18.45.78.H01.1.454.CMB.2.raw
  modified_base (303)..(303): a, c, t, g, unknown or other
  misc_feature (303)..(303): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtgcagcagccacaggacgcccactcccgaggtgcagctggtgcagtcgtgggctggaggtagaagagccgtggggcctgaggtagacggtctccgtgcaaggtcttcgtaggactacaccttccgaccggtactactatactacacgtgggtnccgaccgacggcccctaggacgtagggtcttaggagtggagtgggattaggactaccgaaccctaagaaggttcggtaggaccaactaaaactgtcgactaacgagttacgttcgagggtacgacgggtaccacgtacgtacgaaccgagggacaccgttacactacgacacaaccgagtccctaaggacgtagggactacgacggacacggacggtactaaggacgtactcggtacgaaccggaccgttaccgggtccgttagttaacgttccgttgggttcgaccgggtaagaaccggttcggtaaacggttacggtttacgggtttaagttttaacggggtttaagggg

SEQ ID NO: 355817 - DNA, 538 bp, Homo sapiens
  misc_feature: GZ8MTXP01BA49A.45.78.H01.1.454.CMB.2.raw
  modified_base (338)..(338): a, c, t, g, unknown or other
  misc_feature (338)..(338): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (395)..(395): a, c, t, g, unknown or other
  misc_feature (395)..(395): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaggtctcctgcaaggcttctggatacaccttcaccggctactatatacactgggtcgcgacaggccccctggacaagggctgagtggatgggatggatcacctacatgngcanaaactangcanagagtttcagggcaggtcacatagaccagggacacgtccaancagacacgtacgacctacggagtcggagcgtagacgcgaggacgtagagacgtcgtacgaaccggaacgacggtccgttagtaacgttacgttagcggacggaaggaggaacgtaggtaagttacgttaagtttaaggtaagg

SEQ ID NO: 355818 - DNA, 632 bp, Homo sapiens
  misc_feature: GZ8MTXP01A5N18.45.78.H01.1.454.CMB.2.raw
  modified_base (273)..(273): a, c, t, g, unknown or other
  misc_feature (273)..(273): n is a, c, g, or t
  modified_base (327)..(327): a, c, t, g, unknown or other
  misc_feature (327)..(327): n is a, c, g, or t
  modified_base (614)..(614): a, c, t, g, unknown or other
  misc_feature (614)..(614): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagaagtttcagggcagggtcaccatgaccagggacacgtccatcagcacagcctacatgganctgagcaggctgagatcgtagacgacgacggtccgttagtacttacgtggtcgnggtaggaggcgaaggtaaactttacggtagtttttgggagtttggttagttcgggaacgttagtgggtaccgtcgggtggggacccgaaggggacctacgggtaccaccgtctccgtctcgtcctacccgaccgaccgggccctacgtcccgtaccttcccccgtcgtcccacccgtcccgtaccgaaacgccgccaccgtccggtcgggggaccacgcgtccggcccgtcgggcctcgccgtcggttcgacgggtccttaccgttcttcgtaacgtcgccgttcgnggacggtcgggttcgcgg

SEQ ID NO: 355819 - DNA, 727 bp, Homo sapiens
  misc_feature: GZ8MTXP01AI2XL.45.78.H01.1.454.CMB.2.raw
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccgcctcatctcctgcaggtctagtcaaagcctcctatacgagggataggaaactactctacttgtaattcggttacaaacgaggacggccaaggccaaatcctaccgaaaggccgtaacctttaaagttttaacgtaaacgggttttccgtaaaacccgggggtacttccggtacgggggtaccccaaggtaaccgtaagtaactttcgaaggtccggccgtagggttcggggtacaacgggactaaccgttagtaactttacgaaccgtaaagttaagggtaaaaagtttaggggtaagggggtagggaacgggtcgtagggtaagggtagtttagggttaggttaagttttacgtttcgtagtacgtagtaggtaccgtaaaggtactaacgtacgtcggtaccgttactacggtttcggaccgacggggtacctaaggtacgtaacggaacttaacgaaacgttacgtggttacgtacgtcgaccgttacttagttcctagtccttacacttcccgtcccgttctaacg

SEQ ID NO: 355820 - DNA, 308 bp, Homo sapiens
  misc_feature: GZ8MTXP01CT3MI.45.78.H01.1.454.CMB.2.raw
  modified_base (297)..(308): a, c, t, g, unknown or other
  misc_feature (297)..(308): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatggagctgagcggctaggcaaggcgcatagnnnnnnnnnnnn

SEQ ID NO: 355821 - DNA, 650 bp, Homo sapiens
  misc_feature: GZ8MTXP01COAZ7.45.78.H01.1.454.CMB.2.raw
  modified_base (242)..(242): a, c, t, g, unknown or other
  misc_feature (242)..(242): n is a, c, g, or t
  modified_base (417)..(417): a, c, t, g, unknown or other
  misc_feature (417)..(417): n is a, c, g, or t
  modified_base (494)..(494): a, c, t, g, unknown or other
  misc_feature (494)..(494): n is a, c, g, or t
  modified_base (589)..(589): a, c, t, g, unknown or other
  misc_feature (589)..(589): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctggaggtagaagaacgccgtgggcctcgagtgaagtctcngcgagtcttcgtagactacctaccttcgaccggtactaactatacgtacgtcggtgggtacaccggacgaccggggtccccctagggaacggaagggttcgttaggaggtggaggtagggggtatacggaactaccgaaacctaacgtaggtggtacgaacaaactaaaacgttntcgacgtaaagagggttaagttcggacggggtaccgacgggtaccacgactacggaccggaggacccacgtaccganacgacgaccaacacgtacccagtacggaggcgtagacgagcgtaggaccgtagacgcgtacgtcgggaacccgagccggtcgttagttaccggtnttcgggttgacgaagggtacgtaagttaagggtagttacggtttggttaagggtttaaggg

SEQ ID NO: 355822 - DNA, 610 bp, Homo sapiens
  misc_feature: GZ8MTXP01CIUUS.45.78.H01.1.454.CMB.2.raw
  modified_base (388)..(388): a, c, t, g, unknown or other
  misc_feature (388)..(388): n is a, c, g, or t
  modified_base (552)..(552): a, c, t, g, unknown or other
  misc_feature (552)..(552): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagccgtgggcctgagtgagtctcgtgacgagtctgtgactacacctcaccgtctactatatacgacgtgggtcgcgacgaccggtcccccgtagggaaccgtaaggggtctaggacggtgggtagtggggatggaactaccgaaacctaagaggtggtacgaacaactaaaactntcgacaagtagtaacggtcgagggacacgggtacacgagtacgacgacggacaccgtacactacgagacctacacgtacctaacggagtaggactcgtacggacgcgaaggtctaaggacgtacgtcgacggaaccgacgttaccggtcgttagtaacgttcgnggttcgacggaagtacggaacgttaagggtaacgttaggtttaaggtttgggtaacgg

SEQ ID NO: 355823 - DNA, 571 bp, Homo sapiens
  misc_feature: GZ8MTXP01EWP3G.45.78.H01.1.454.CMB.2.raw
  modified_base (526)..(526): a, c, t, g, unknown or other
  misc_feature (526)..(526): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagaagccgtggggcctcgagtgaaggtctccgtgcgaaggtcttcgtggactactaccttcgaccggctactatatacacgtgggtgcgacgacggccccctaggaacgaagggtcttaggagtaggagtgggattggaactaccgaaaccctaacaagtggtagacaacaaaactatgacaagagtaagttcgagggcagggtcactagacgacgaggacacgtacatacagcacacgacctagagtggacgtcgagacgcgaggtcgagacgacgtcgagaaccggcgacgggtcgttagtactagttggngacggaagaggaacgtagggtattagttaaggttttaaggtaagg

SEQ ID NO: 355824 - DNA, 729 bp, Homo sapiens
  misc_feature: GZ8MTXP01AX3YG.45.78.H01.1.454.CMB.2.raw
  modified_base (249)..(249): a, c, t, g, unknown or other
  misc_feature (249)..(249): n is a, c, g, or t
  modified_base (262)..(262): a, c, t, g, unknown or other
  misc_feature (262)..(262): n is a, c, g, or t
  modified_base (281)..(281): a, c, t, g, unknown or other
  misc_feature (281)..(281): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccgaggtgcagcgtggtgcaggtcgtggggctggaggtgaagagccgtgggcctgagtgagtctctgcagctngatcacctcacgntactatactacacgtggtncgacgacggccccgtaggaacgacgggtcttaggaacggtgggaagtgggggaattacgggaactacccgtaaaacccgttaaagtacgttaggggtacggaacctaaaaccgaaaaaaactttgcggaacctaaacggtaaagggttaaaccgtttcgggaacgggggactaacggggttaccaaccggtaatacgggaacccggaacgggtaccaacccggttaccagtaccaacggacaactacggaccccttaaggaagtggggactacggtaggacgacgacggtaccgtaggaacgtaacgttccggtacgggaaacccgtaccgggaccggttacccggttaagttaaccgttaacgttggggccgttaacggggaacggtagggttaaccgaaggggtttaacgtttaaggtttaaggggttttggggtttaaaccgggg

SEQ ID NO: 355825 - DNA, 751 bp, Homo sapiens
  misc_feature: GZ8MTXP01ANHZA.45.78.H01.1.454.CMB.2.raw
  modified_base (715)..(715): a, c, t, g, unknown or other
  misc_feature (715)..(715): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagtcacaggacgcccactcccaggtgcagctggtgcagtcgtgggctggaggtgaagagcgtgggcctgagtagaggtctacctgacaaggtcttcgtaggactaccgaccttcgaccggtactactactataccacggtgggtacgccgacgaccgggccccctaggggaaccgaaggggtacctttagggaggtagggaagttgggggtaattacgggaacttaccgtaaaacccccgttaaacgtaaaggttcggggacggaaccaaacggtaaaaaaacccttagtaacggtaaccaaacgtaaacggttaaacggttttaccggaaacgggggtccgtaaacgggggttaccccaaacgtaacgtaccgggaaccggaaacgggggtacccaaaaccgggttccctaacgtaaccgaaccggtaccaaccggaaccggttaaacccttaaccggaaagttcggggaaacgtccggtaacggagacccggagttaccgacggaaggtaacttccgaaggaacccgaacggcgtacggttattacgttaagttgngacgaagcgaagtaagtagttgtaagtttggtaagg

SEQ ID NO: 355826 - DNA, 726 bp, Homo sapiens
  misc_feature: GZ8MTXP01EINOT.45.78.H01.1.454.CMB.2.raw
  modified_base (224)..(224): a, c, t, g, unknown or other
  misc_feature (224)..(224): n is a, c, g, or t
  modified_base (245)..(245): a, c, t, g, unknown or other
  misc_feature (245)..(245): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagcgtgggctnagtgagtctctgacaggtctntggactacaccttcgaccgctactatatacgacgtggtcgcgacgacggcccctggacgaagggtcttaggaggtgggagtgggatggactacaacctaaacgagtgggtcggacaactaaaaacctatgactaaacgaaggttaacggtttacggaacggggtacgtaacggggtacccaaccgtaacgtacgggaacccggaacggggtaacccgaaccgggtttacccaacgtaccgaacggacccaacgaaaccgtacccgttaaaccggaggttacgggaacgttaccgagggaacgttacgggaccggtacgttaggaacggtacgttcggacggaaccggaaaccggttcccgggtacggtttagttaaacgtttaaccggttgggttacggaaccgggtaaggggtaaccggaacggttaaagggttaaaccggttttacgggtttaagggttttttaacgggtttaaggggg

SEQ ID NO: 355827 - DNA, 758 bp, Homo sapiens
  misc_feature: GZ8MTXP01B4DZK.45.78.H01.1.454.CMB.2.raw
  modified_base (137)..(137): a, c, t, g, unknown or other
  misc_feature (137)..(137): n is a, c, g, or t
  modified_base (264)..(264): a, c, t, g, unknown or other
  misc_feature (264)..(264): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtncgacaggccccctggacaagggcttgagtggatgggatggatcaaccctaacaatggtggcacaaactatgcacagtaagtttcagggcagggtcaccatcgaccgaggacacgtccatcagccacngcctacatggagctgagcaggctgagctctggaccgacgaccggtccgttagttacttacgtggtcgacggtaggaggacgtagggtaaatttacgtttaggttttcgggtaggtttggttacgttcgggtaaacgggttagttcgggtacgttcgggttacggggacccgtaacgggggacccgacgggtccctacccggttacctcccgtacgcggtacccctccgaacccgaacgggtcccacgttcccggttccccttccccgtacggtccccctacccctcccgaacccgtaaacgccgtacccgtcccgtcgggtaccgggggacacccggtccggtcccgggggccctttccgggggccttcccggggttacccggtttcgggttaaacccgtaaccgggttaacccctttcccggtttcccgttaccgggtcccgttcgggttcccccgtgggttcgggccggggttccggcggttaacccggggg

SEQ ID NO: 355828 - DNA, 759 bp, Homo sapiens
  misc_feature: GZ8MTXP01DWMLJ.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgatcagggacacgtccatcagcacagcctacatggagctgagcgaggctgagatcgtagacgacgacggtcccgtaggttatttactggtagcggaggacggtacgaggtaaacgtttaaccgtagttttttacggggaggtttagggtttaagtttcccggggaacgggttaagttggggtaacccgggttaccggttacggggggacccgaaacgggggtaccccgaaccgggttaccgtaacccggttccgtaccccgttacgaccgccccgttacccgaacccgaaaccgggggtccccctaccgtacccgggttcccttaccccccgttccgggtacccgtaaccccccttcccgttaccccgaaacgtaacggcccgtaacccgttccggttacggggggcctaacccgacggcccgggtccccggtcgggtccgttcggtcccgttcgggtaccgtaacgggttaccttaccgttcccgtcgtacgtcgtccggtccttggtaacggccgggtccgg

SEQ ID NO: 355829 - DNA, 699 bp, Homo sapiens
  misc_feature: GZ8MTXP01AZ5F4.45.78.H01.1.454.CMB.2.raw
  modified_base (582)..(582): a, c, t, g, unknown or other
  misc_feature (582)..(582): n is a, c, g, or t
  modified_base (646)..(646): a, c, t, g, unknown or other
  misc_feature (646)..(646): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcgttggtggcagcagccacaggacgcccactcccgaggtgcagctggtgcagtcgtgggctggaggtagaagacgccgtggggcctcgaggtgaacggtctccgtgacgtaaggtcttgtacggaactaccgtaccttccgaccggacttaactatacgtacctacggttgggcgacggaccgaccgggacccccgtagggaaccgtaaggggtcttagggaggtgggaacggtggggattacggaactaaccctaaacccgtaaacgaaggtcggtaacggaaccaaacctaaaaaacttgcgaaccaaacgtaggttaacggtttacggaacggggacgtaaaccgggtaccaacgtacgacggaaccggaacggaccgtaccgtaccagaccgacgacaacgtacgtaacccgtggaaaggttcgggctacggngaacgccgaggtacgagacgtatccggacggaaccgacggttacggtacttggtaacgttaggngttacggacggtaagacggtaaggtaaggttagttaggtttggtttgggtaag

SEQ ID NO: 355830 - DNA, 545 bp, Homo sapiens
  misc_feature: GZ8MTXP01D3KT4.45.78.H01.1.454.CMB.2.raw
  modified_base (269)..(269): a, c, t, g, unknown or other
  misc_feature (269)..(269): n is a, c, g, or t
  modified_base (350)..(350): a, c, t, g, unknown or other
  misc_feature (350)..(350): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtatagtaactggtgctggtatcagcagaacagggaaacnccctaaagctcctgctctataaggctaatctaagtttagaaagttgggccatcaaggttcagcgcagtgatcgtagggacngaatcactctcacatcagcagcctgcagcctgatgattttgactaaactttatttactacgtacctaaatagttaatagtaatttacgtttaaagtttccgtaacggtttccggaaccgtaaaggggaaccaaaggttaggaaacttacgaaacgtaacgttgttggactgcaacctatccttgttcttctaacc

SEQ ID NO: 355831 - DNA, 694 bp, Homo sapiens
  misc_feature: GZ8MTXP01AXPO2.45.78.H01.1.454.CMB.2.raw
  modified_base (294)..(294): a, c, t, g, unknown or other
  misc_feature (294)..(294): n is a, c, g, or t
  modified_base (380)..(380): a, c, t, g, unknown or other
  misc_feature (380)..(380): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagcgtggtgcagtcgtgggctggaggtgaagagccgtgggcctcgagtgaggtctcgtgcaggtctcgtgactactccttcgaccggtctactatactacacgtgggtcncgacgcggcccctagggacagggtcttaggagtggagtgggatggaactacaaaccctaactaggtggtacgacaactaaaacgtntcgacaacgagttaaacggttcgacggggtacgtacgggtaccaaaccgtaggaccggaacccggtaagggaacccgtaacccggttacccaaagtacccgaacgaccgtaaccgacgtacccgtaacggacggtacggacgtacggtacgggacggaccggtaggacgtacgaacgtacgtaccggaacggaacccggtacggttaccggtacgttaacgtaccgttacggttggttacggacggggaaggtaacgggtaacgttaaacgggtttacggtttaacgggttttaagggttttaacgggtaaggg

SEQ ID NO: 355832 - DNA, 711 bp, Homo sapiens
  misc_feature: GZ8MTXP01D1L6W.45.78.H01.1.454.CMB.2.raw
  modified_base (271)..(271): a, c, t, g, unknown or other
  misc_feature (271)..(271): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagtaagtttcgagggcagggtcaccatgaccgagggacacgtccatcagcacacgcctanagtggagctgacgcgaggctggagactcgtaggaaccgacgacgggtccgttagttaactttacgtggtcggcggaaggaggacgtaaaggttaatttagttaggtttaggtttttagggaggtttaggtttacgttacgggtaggttggtcgggtacgtcgggtacggggaccgaacggggtacctacggtacctaccggtctccgtcgaccgtcccgtacccgaccgaaccggcccctacgtccccggttccccttccccgtccggacccctaccccttcccgtaacccgaacgtaccgcccgtacccggtcggtaccgggggcctaccggccggcccggtcccggtgggtccgttcggtcccggttcggtaaccgtaacggttaccgttccgttaccgtcggtacgtccggtcggtcgttcgggtcggcgggtccgg

SEQ ID NO: 355833 - DNA, 737 bp, Homo sapiens
  misc_feature: GZ8MTXP01D04VD.45.78.H01.1.454.CMB.2.raw
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (251)..(251): a, c, t, g, unknown or other
  misc_feature (251)..(251): n is a, c, g, or t
  modified_base (262)..(262): a, c, t, g, unknown or other
  misc_feature (262)..(262): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactccaggtgcagctggtgcagtcgtggggctgaggtgaagagctgggctgagtgagtcnctgcagctngatacactcacgcactanatacactggtncgacagcccctaggacaagggcttgagtggatgggatggactacaaaccgtaacaaagtggtggaccaaccaaactagtacggacaaaccgtaagaaggttttaccgaaggggaccgtaacggggtaccctaaccgacgttacggaacccggaaacggggtaaccgaaaccggttaccctaaacgtacccgaacggacccgaaaccttaacggaaccccttaaccgaaagttacggggtaaacggcccggttagggaaacggcccgggtaacccggtacgggtaacggtaaagggaaccgttaaaccggtacggtaaaccggaccgaaaccgggtccggttaagggtacccttttaaacggggtacggttacgggacggtaacgggaacgggacggttaaacggttaaacggtttaaggtttaacggttttagggttacgggttacgggtttaacgggtttaaccgggtaacggg

SEQ ID NO: 355834 - DNA, 618 bp, Homo sapiens
  misc_feature: GZ8MTXP01DK88T.45.78.H01.1.454.CMB.2.raw
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
tcagacgcgatcgacacgaccggtgctcgatttagtgtgagtagtttgggtttgggttgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcacatgaccagggcacgtccatcagcacagccctanatgganctagagcgagcgtgagatctagacgacgacggcgtgtattagtgtgcgagaggacgagtaagttaagttagtttaggtaggttaggttagttacggtaacggtagtggtacggtcggtcgggacggaacgggaccgacggtaccgtaccgtcctcctacgacgccgtacccgaccgaaccggacccgaccgtaccggttcccgttccccgtccgacccgtaccccgtcccgtaccgaacgacgaccgaccgtcggtacgggacgacgtacggccggccgcggcgtcgccgtcggttacgaacgtacttaccgttccttcgtcgtcgtcgtcgtcgacggtcggcgcg

SEQ ID NO: 355835 - DNA, 665 bp, Homo sapiens
  misc_feature: GZ8MTXP01B0MR7.45.78.H01.1.454.CMB.2.raw
  modified_base (259)..(259): a, c, t, g, unknown or other
  misc_feature (259)..(259): n is a, c, g, or t
  modified_base (270)..(270): a, c, t, g, unknown or other
  misc_feature (270)..(270): n is a, c, g, or t
  modified_base (311)..(311): a, c, t, g, unknown or other
  misc_feature (311)..(311): n is a, c, g, or t
  modified_base (395)..(395): a, c, t, g, unknown or other
  misc_feature (395)..(395): n is a, c, g, or t
tcagacgcgatcgacacgaccggtgctcgatttagtgtgagtagtttgggtttggggtgaagaagcctggggcctcagtgaaggtctcctgcaacgcttctggatacaccttcaccggctactatatacactgggtgcgacaggcccctggacaagggcttgagtggatgggatggatcaaaccctaacaatggtggcacaaaactatgcacagaagtttcaggcaggtcacatgaccagggacacgtccatcagcacngccacatgganctgagcagctgagatcagacgacaggccgtagtatttacgngtgcgtaggagacaggtaaattacggttaactttttcgggaagtcggtttaattccgggaaacgggtattcggggacgttccgngggggacccaaaggggaccccgtaggtcccaaccggttcctacctccgacggtacccctcccgaaaccgaaccgggccccaattccccgggtccttccccctggtccccacccctacccgtacccaaacggaccgaccgtacccgtccggtacggggacccacaccgggccggtcccgtgggggctcggccgttagggttaccgaaggttaccttaccgtttcccgacgtaagttcccggctttcggcgaggccgggttcgtaaccgggg

SEQ ID NO: 355836 - DNA, 515 bp, Homo sapiens
  misc_feature: GZ8MTXP01EXBAJ.45.78.H01.1.454.CMB.2.raw
  modified_base (287)..(287): a, c, t, g, unknown or other
  misc_feature (287)..(287): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (439)..(439): a, c, t, g, unknown or other
  misc_feature (439)..(439): n is a, c, g, or t
  modified_base (445)..(445): a, c, t, g, unknown or other
  misc_feature (445)..(445): n is a, c, g, or t
  modified_base (447)..(447): a, c, t, g, unknown or other
  misc_feature (447)..(447): n is a, c, g, or t
  modified_base (456)..(456): a, c, t, g, unknown or other
  misc_feature (456)..(456): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (493)..(493): a, c, t, g, unknown or other
  misc_feature (493)..(493): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtncgacaggcccctggacaagggcttgagtggatgggatggatcaaaccctaacaatggtggacacaaaaaactatgcaacagaaagttttcgaggggcaggggtcaccatgaccagggacacgtccatcagcacagcctacatgggancgngngcgagngngagagtcgngaacgacgacggtcgttgtagtagttgngngaagagngagtagttagttaagtttggtg

SEQ ID NO: 355837 - DNA, 587 bp, Homo sapiens
  misc_feature: GZ8MTXP01CZ7DM.45.78.H01.1.454.CMB.2.raw
  modified_base (250)..(250): a, c, t, g, unknown or other
  misc_feature (250)..(250): n is a, c, g, or t
  modified_base (289)..(289): a, c, t, g, unknown or other
  misc_feature (289)..(289): n is a, c, g, or t
  modified_base (294)..(294): a, c, t, g, unknown or other
  misc_feature (294)..(294): n is a, c, g, or t
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagcctggggcctcagtgaaggtctctgcaaggcttntggatacaccttcaccggtctaactataatacactggtncgacncggcccctggacaagggcttggagtgggatgggatggatcaaaccctaanaattggtagcaacaaaaactancgacacagtaaacgtttcgagggtcacgggtacacgatcggacacggacacgtcatcagcacacgcctacgagtggagacgtggacgcgaggacgtaggaggtactccgtaggaaccggaacgacgggtacccgttggtttaaacgttcgttggttcggacggaagggtacgggaacgtacgggtaaagtttaaccgggtttaagttttttgggtaagggg

SEQ ID NO: 355838 - DNA, 671 bp, Homo sapiens
  misc_feature: GZ8MTXP01C8VUD.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagtaagtttcgagggcagggtcaccatagacaggacacgtccatcagcacagcctacagtggagctagagcgagctgagtatctagacgacacggtccgtgttatactgtgacgagaggacaggtaattacgttagttttggagttgttagtcggtaacgtagtggacgtcgtacggggaccgtaagggacccgtacgggtccctaccgttcctccgtcgaccgaccctacccgaaccgtaaccgggtccctacgttccccgtcccgttcccccgacgtacccctaccccggttccctaccgaaacggaccgtaccgacccgttccgggacgggggacccaacgaccggcccgggtcccgacggggtccttccggccgttcgggaaccgtaaacgggtacccttacccgtttccaccggttaactcggtaaccgttcgacggcgggccggttgtaacggg

SEQ ID NO: 355839 - DNA, 708 bp, Homo sapiens
  misc_feature: GZ8MTXP01EUPIZ.45.78.H01.1.454.CMB.2.raw
  modified_base (189)..(189): a, c, t, g, unknown or other
  misc_feature (189)..(189): n is a, c, g, or t
  modified_base (262)..(262): a, c, t, g, unknown or other
  misc_feature (262)..(262): n is a, c, g, or t
  modified_base (275)..(275): a, c, t, g, unknown or other
  misc_feature (275)..(275): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggccccctggacaagggcttgagtggatgggatggatcaaccctaanaatggtgcaacaaactatgcacagaagtttcagggcagggtcaccatgaccagggacacgtccatcagacacngcctacagtgganctgagcgaggctgagactcgtagacgacgacggccgtgtacttacgtgtgcgaggaggcaaggtaactttaggttacgttttgggtagttacggtttattccggggtaaaggtttacgtggggtaaccggttcggcgggggaccgaaacgggggtaccccgtacgtcccgaccgttcgtccctcgaccggtacccaccgaaacccgccgggtaaccctccgttccggttcccctttccccgtacggacccctaccccgtccttaacccgaacgacccgcctacccggttcgggtaccgggggcccaccgtcgggccccggcccgggttcgggccccgttggttaccccggttacggttaccggtaaacccgggtttcaaaccggtttccttccggtcctcggtcggtccgtcggttacgtcggggcggtcggg

SEQ ID NO: 355840 - DNA, 716 bp, Homo sapiens
  misc_feature: GZ8MTXP01BYS5W.45.78.H01.1.454.CMB.2.raw
  modified_base (230)..(230): a, c, t, g, unknown or other
  misc_feature (230)..(230): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtagaagaagccgtggggcctnagtgaaggtctctgcagtctgtggatacacctcaccgctactatatacacgtgggtgcggacacggccccgtagggacgaagggtcttaggaggtgggagtggggataggactacgaaaccctaacaaggttggtacggaccaacgtaaaaaaacttagtcgacgaaaccgaagggttaaacgttttcggaagggggacgtacgggtaccacgatacggaccgtaacgggacctacgtccaatccgaagaccaaccgacgtaccctaacggtacgttacggggacgacgtacgggaaggacggacggtaccggtagtaacgggtacgtaacgtccgggaaccggaaccggttacccggggttaccccggttagggtttaaacgttacggttacgggttcggaccggggtaagggacgggtaaacccggtaagggggtttaaaccgtttagggtttaacgggtttttttaacgggggtttaaggggg

SEQ ID NO: 355841 - DNA, 672 bp, Homo sapiens
  misc_feature: GZ8MTXP01E1WBR.45.78.H01.1.454.CMB.2.raw
  modified_base (252)..(252): a, c, t, g, unknown or other
  misc_feature (252)..(252): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctggaggtgaagagccgtggggcctcagtgaggtctcctgacaaggtctcnggatactacccttcaccggctactataatacacgtgggtgccgacgacggccccctgggacaagggtcttaggaggtgggagtgggggataggactccaaaccctaacaagtgggtaggacaacctaaaaactatcgaccaacaaacggttaacggtttacgacgggggacgtacggggtccaacccgtagtacggaacccgtaaagggggactaacccggtacctactaccaggcccaaacctaaccgacccttaaccgagtcggggtagtaccgtagggacggtccggacgggtccgtagaacggtacgtaccgtaggaaccgaacccgttacgggcccgttaagttacttacgttgggttgacggtgggaggtaaccgtaagggttaacgttaacggttcgtttttaagggaacggg

SEQ ID NO: 355842 - DNA, 675 bp, Homo sapiens
  misc_feature: GZ8MTXP01B4VAP.45.78.H01.1.454.CMB.2.raw
  modified_base (189)..(189): a, c, t, g, unknown or other
  misc_feature (189)..(189): n is a, c, g, or t
  modified_base (274)..(274): a, c, t, g, unknown or other
  misc_feature (274)..(274): n is a, c, g, or t
  modified_base (299)..(299): a, c, t, g, unknown or other
  misc_feature (299)..(299): n is a, c, g, or t
  modified_base (314)..(314): a, c, t, g, unknown or other
  misc_feature (314)..(314): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaaccctaanaatggtggcaacaaaactatgcaacagaagtttcagggcagggtcaccatgaccaggacacgtcatcagcacagcctacatgganctgagcgagctgaagctctagacanacggctgtattacgngtgacgagagacaaggtaattacgtacgtttggagttgttatcggaaacgttatcggtacgtcgacgggaccaaggggacctacggtcacccgtctacctacgacgtaccctaccctaaccgaacgggtcccctaacgtcccggtccccgtttaccccgtacggtacccgtacccgttaccctaccgtaacgtacgaccgtaacccgtcggtaccggggaccaccgtcggtacccggtcccgttgggcccgtcggttacccgttcgggttaaacccgtaaacgggtaaccttacccgttcccttaccggtaacgttcccggtaacgtccggttacggaccgggtccggggttaacgtccgg

SEQ ID NO: 355843 - DNA, 536 bp, Homo sapiens
  misc_feature: GZ8MTXP02I60TF.45.78.H01.1.454.CMB.2.raw
  modified_base (419)..(419): a, c, t, g, unknown or other
  misc_feature (419)..(419): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacactcacttgaattggttcaacagaggccaggccaatctccaaggcgacctaatttataaggtttctaaccgggactcgtcggggtcccagacagattcagcgcagtggtcaggcactgatttcacactagaaaattggagggtggagctgaggatgttggtagtttattcngtcagtgacaaggtacacacgtggaccgtactacgtttggccgtagggggaccaaggctaggaaactacgaaaacgactgtaggctcgaccacatcgtgtcttcattcctccgctac

SEQ ID NO: 355844 - DNA, 525 bp, Homo sapiens
  misc_feature: GZ8MTXP02F50EC.45.78.H01.1.454.CMB.2.raw
  modified_base (470)..(470): a, c, t, g, unknown or other
  misc_feature (470)..(470): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtctgggggccaaggggaccacgggtcaccgtctcctcagcctccaccaacgggcccatcggtctcccctggccaccctcctccaagacgcacctctgggggcacngcgccctgggctgcctggtcaaggctactctcgaatcgcgtctgcgcggcgtcgg

SEQ ID NO: 355845 - DNA, 531 bp, Homo sapiens
  misc_feature: GZ8MTXP02I537G.45.78.H01.1.454.CMB.2.raw
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgtaggtctagtcaaagcctcctatacagggatggaaacactcacttgaattggttcaacagaggccaggccaatctccaaggcgcctaatttataaggtttcaaccgggactctggggtcccagacagattcagcggcagtgggtcaggcactgatttcacactgaaaattgtagggtgaggctgaggatgttggagtttattctgtcatgacaaaggtacacactggaccgtacgacttttcggcctagggggaccaaaggccgtaggaaaatcgaaaacgactgtaggctaggcaccatctgtctcactcttccgcatc

SEQ ID NO: 355846 - DNA, 504 bp, Homo sapiens
  misc_feature: GZ8MTXP02F5KTK.45.78.H01.1.454.CMB.2.raw
  modified_base (356)..(356): a, c, t, g, unknown or other
  misc_feature (356)..(356): n is a, c, g, or t
  modified_base (423)..(423): a, c, t, g, unknown or other
  misc_feature (423)..(423): n is a, c, g, or t
  modified_base (442)..(442): a, c, t, g, unknown or other
  misc_feature (442)..(442): n is a, c, g, or t
  modified_base (474)..(474): a, c, t, g, unknown or other
  misc_feature (474)..(474): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtctggggctgaggtgaagagcctggggcctcagtgaaggtctcctgcaaggcttctggatacaccttcaccggctactatatacactgggtgcgacaggccccctggacaagggcttgagtggatggggatggatcaaccctacaatggtggcacaaactntgcacagaagtttcagggcagggtcaccatgaccagggacacgtccatcagcacagcctacatgganctgagcgaggctgagatcngacgacgacggccgtgtacttacgtgtgacgngacggacaggaattacgagttttaggtagg

SEQ ID NO: 355847 - DNA, 536 bp, Homo sapiens
  misc_feature: GZ8MTXP02IEE8W.45.78.H01.1.454.CMB.2.raw
  modified_base (294)..(294): a, c, t, g, unknown or other
  misc_feature (294)..(294): n is a, c, g, or t
  modified_base (416)..(416): a, c, t, g, unknown or other
  misc_feature (416)..(416): n is a, c, g, or t
tcagacgcgatcgacacgaccggtgctcgatttagtgtgagtagtttgggtttgggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacactcacttgaattggttcaacagaggccaggccaatctccaaaggcncctaaatttataaggtttctaaccgggactctggggtcccaggacagattcagcggccagtggtcaggcactgatttcacactagaaaattggaggtgagctgaggatgtgagtttatttcngcatgcaaaggttacactacgttggccgtactacgttttggccgtagggggaccaagccgtagggaaaatacgaaaacgaacgtgtaggcttgacacatctgtcttcattcttccgctac

SEQ ID NO: 355848 - DNA, 539 bp, Homo sapiens
  misc_feature: GZ8MTXP02H4HG9.45.78.H01.1.454.CMB.2.raw
  modified_base (512)..(512): a, c, t, g, unknown or other
  misc_feature (512)..(512): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggaggtatgggacgtctggggccaagggaccacggtcaccgtctccgtcagcctccaccaacggggcccatcggtcttccccctggccaccctcctccaagacgcacctctcgggggcacagcggccctggggctgcctggtcaaggacctacgtttcccncgtcgtcgcgtcgtgacggcggcgcgg

SEQ ID NO: 355849 - DNA, 533 bp, Homo sapiens
  misc_feature: GZ8MTXP02IZRLL.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggttatggacgtctgggggccaaggggaccacggtcaccgtctcctcagcctccaccaacgggccatcggtcttcccctggccaccctccctccaacgagccaccctctcgggggcacagcgccctgggctgcctggtcaacggactacttcctcgaatcgcgtctgacgcggctgg

SEQ ID NO: 355850 - DNA, 511 bp, Homo sapiens
  misc_feature: GZ8MTXP02JJJMU.45.78.H01.1.454.CMB.2.raw
  modified_base (436)..(436): a, c, t, g, unknown or other
  misc_feature (436)..(436): n is a, c, g, or t
  modified_base (449)..(449): a, c, t, g, unknown or other
  misc_feature (449)..(449): n is a, c, g, or t
  modified_base (457)..(457): a, c, t, g, unknown or other
  misc_feature (457)..(457): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (489)..(489): a, c, t, g, unknown or other
  misc_feature (489)..(489): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagcgtgaagatctagacgacacggccgtgtattactgtgcgagaggcaggaattacgattttggagtggttattggacgtatggacgtctggggccaaggggcacggtcaccgtctctcagcctccacaggcccatcggtctcccctggccacctccncacacgcactcgnggggcacngcgcccgnggcncgcgtcgcacgactactccncgcgtcgcgtctgcgcggcgcg

SEQ ID NO: 355851 - DNA, 510 bp, Homo sapiens
  misc_feature: GZ8MTXP02GD5KT.45.78.H01.1.454.CMB.2.raw
  modified_base (444)..(444): a, c, t, g, unknown or other
  misc_feature (444)..(444): n is a, c, g, or t
  modified_base (475)..(475): a, c, t, g, unknown or other
  misc_feature (475)..(475): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccggctactatatacactgggtgcgacaggcccctggacaagggcttggagtggatgggatggatcaacctaacaatggtgcaacaaactatgcacagtagttcagggcagggtcacatgacgaggacacgtccatcagacacagcctacagtggagctagagcgagcgtagagatcgngaacgacgacggccgtagtaacttcgtcggngagaagacgacgaggtagttacgttagtttaggag

SEQ ID NO: 355852 - DNA, 524 bp, Homo sapiens
  misc_feature: GZ8MTXP02JGN22.45.78.H01.1.454.CMB.2.raw
tcagacgcgatcgacacgaccggtgctcgatttagtgtgagtagtttgggtttggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagttagaaagtggggtcccatcaagtcagcgcagtgatctgggacagattcactctcaccatcagcagccctgcagccctgatgtatttgactaacttattactgacctaaacagtatgtaattagttattcgtacgttacggaccgtaaagggacctaaagggtaggaaaatacgaaaacgaactagtacggctagaaccaccatctagtcttacacttccc

SEQ ID NO: 355853 - DNA, 493 bp, Homo sapiens
  misc_feature: GZ8MTXP02GCZPG.45.78.H01.1.454.CMB.2.raw
  modified_base (412)..(412): a, c, t, g, unknown or other
  misc_feature (412)..(412): n is a, c, g, or t
  modified_base (418)..(418): a, c, t, g, unknown or other
  misc_feature (418)..(418): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagttcagggcagggtcacatgacagggacacgtcatcagcacagcctanactganctgagcaggctgagatctgacgacacggccgtgtacttactgtgcgaagagacaggaattacgagtttaggtagg

SEQ ID NO: 355854 - DNA, 504 bp, Homo sapiens
  misc_feature: GZ8MTXP02HSIIF.45.78.H01.1.454.CMB.2.raw
  modified_base (436)..(436): a, c, t, g, unknown or other
  misc_feature (436)..(436): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggccccctggacaaggcttgagtggatgggatggatcaaaccctaacaatggtggcacaaaactatgcacagaagtttcagggcagggtcaccatgaccagggacacgtccatcagcacagcctacatggagctgagcgaggcngagatctagacgacgacggccgtgtattactcgtgcgaagaggacgagaagtacgtagtttagttagg

SEQ ID NO: 355855 - DNA, 547 bp, Homo sapiens
  misc_feature: GZ8MTXP02H8JDG.45.78.H01.1.454.CMB.2.raw
  modified_base (270)..(270): a, c, t, g, unknown or other
  misc_feature (270)..(270): n is a, c, g, or t
  modified_base (288)..(288): a, c, t, g, unknown or other
  misc_feature (288)..(288): n is a, c, g, or t
  modified_base (310)..(310): a, c, t, g, unknown or other
  misc_feature (310)..(310): n is a, c, g, or t
  modified_base (359)..(359): a, c, t, g, unknown or other
  misc_feature (359)..(359): n is a, c, g, or t
  modified_base (395)..(395): a, c, t, g, unknown or other
  misc_feature (395)..(395): n is a, c, g, or t
  modified_base (405)..(405): a, c, t, g, unknown or other
  misc_feature (405)..(405): n is a, c, g, or t
  modified_base (419)..(419): a, c, t, g, unknown or other
  misc_feature (419)..(419): n is a, c, g, or t
tcagacgcgatcgacacgaccggtgctcgatttagtgtgagtagtttggggttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcacatgaccagggacacgtcatcagcacagcctacatgganctgagcaggctgagatcngacgacacggccgtgtattacngtgcgagaggcaggtattacgtattttggagttggttattcggaggttntggacgtgtgggggaccaagggccaggtcaccgtcncctcacgtcnccacgacggccacncgtcctccctccgccaccctccctaccacgacgcaccgtcgcggggcgacacgccggcccgtcggtcgtcgccgtcggtacgaacggaccgtaccttcctccgtcgtcgtcgtcgtcgcggcggcgcg

SEQ ID NO: 355856 - DNA, 514 bp, Homo sapiens
  misc_feature: GZ8MTXP02JADNK.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggccccctggacaagggcttgagtggatgggatggatcaaccctaacaatggtggcacaaactatgcacagaagtttcagggcagggtcacatgaccagggacacgtccatcagcacagcctacatggagcgtgagcgagcgtacgaggacgtcagacgacgacggccgtaggtaactacgtcggtgacgaagaggacgacgtaagtacgtagtttaggtag

SEQ ID NO: 355857 - DNA, 528 bp, Homo sapiens
  misc_feature: GZ8MTXP02JSEXR.45.78.H01.1.454.CMB.2.raw
  modified_base (472)..(472): a, c, t, g, unknown or other
  misc_feature (472)..(472): n is a, c, g, or t
  modified_base (478)..(478): a, c, t, g, unknown or other
  misc_feature (478)..(478): n is a, c, g, or t
  modified_base (518)..(518): a, c, t, g, unknown or other
  misc_feature (518)..(518): n is a, c, g, or t
  modified_base (527)..(527): a, c, t, g, unknown or other
  misc_feature (527)..(527): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagctgagatctgacgacacggccgtgtattactgtgcgagaggcaggaatacgatttttggagtggttattcggacggttatgggacgtcgtgggggccaaggggccacgggtcaccgtctcctcagcctccacaacggcccatcggtctccccgtggccaccctcctccagacgcacctcgtcgggggcacgngcgccngggctgcctggccaaggactactcctcgaactcgcgtcgngcgcggcgng

SEQ ID NO: 355858 - DNA, 529 bp, Homo sapiens
  misc_feature: GZ8MTXP02FVDZ4.45.78.H01.1.454.CMB.2.raw
  modified_base (528)..(528): a, c, t, g, unknown or other
  misc_feature (528)..(528): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtattactgtgcgagaggcaggattacgatttttggagtggttattcggacggtatggacgtctggggccaagggaccacgggtcaccgtctcctcagcctccaccaagggcccatcggtctccccctggccaccctcctccaaacgcgcacccgtctgggggcacagcggccctggggctgcctggtcaacggctacttctcgaatcgcgtctggcgcggcgng

SEQ ID NO: 355859 - DNA, 518 bp, Homo sapiens
  misc_feature: GZ8MTXP02H2VQB.45.78.H01.1.454.CMB.2.raw
  modified_base (271)..(271): a, c, t, g, unknown or other
  misc_feature (271)..(271): n is a, c, g, or t
  modified_base (414)..(414): a, c, t, g, unknown or other
  misc_feature (414)..(414): n is a, c, g, or t
tcagacgcgatcgacacgaccggtgctcgatttagtgtgagtagtttgggtttggggtcagacccagtcaggacacagcatggacatgagggtccccgctcagctcctggggctcctgctgctctggctcccaggtgccaaatgtgacatccagatgacccagtctccttccaccctgtctgcatctgtagagacagagtcaccatcacttgccgggccagtcagagtattagtaactggttggcctggtatcagcagaaaccagggaaancccctaagctcctgctctataaggcatctagtttagaaagtggggtccatcaaggttcagcggcagtggatctgggacagattcactctcaccatcagcagctgcagcctgatgtatttgctaaacttattactgacctaaanagtatgtaatagttattcgacgttacggaccgtaaagggaacctaaggtaggaaatacgaaacgaactgtcggactcgaacacactctatcttactacttcccg

SEQ ID NO: 355860 - DNA, 547 bp, Homo sapiens
  misc_feature: GZ8MTXP02JCGXE.45.78.H01.1.454.CMB.2.raw
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacactcacttgaattggttcaacagaggccaggccaatctccaaggcgcctaaatttataaggtttctaaaccggatcgtggggtcccagacagattcagcgccagtgggtcaggcactgatttcacactagaaaattaggtagggtggagcgtgagatgttgtagttatttntgnatgagaagtacacacacgtacgtactacgttcgtacgacggacgaacgacgtagaaagtaacgaaacgaaacgtacgtaggacgtacgacacactcgtcgtacttactactacctccgtacctac

SEQ ID NO: 355861 - DNA, 555 bp, Homo sapiens
  misc_feature: GZ8MTXP02GH29O.45.78.H01.1.454.CMB.2.raw
  modified_base (361)..(361): a, c, t, g, unknown or other
  misc_feature (361)..(361): n is a, c, g, or t
  modified_base (545)..(545): a, c, t, g, unknown or other
  misc_feature (545)..(545): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtattactgtgcgagaggcaggaattacgatttttggagtggttatcggacggttntgggacgtgtgggggccaaggggaccacgggtcaccgtctcctcacgcctccaccgaacgggcccacgtccggtccttccccctggcccaccctccctaccaacgacgccacccgtcgcgggggccacgacgccggcccgtgggctcggcctggtcaacggacctactcctcgaatcgcgtcgngcgcggcgcg

SEQ ID NO: 355862 - DNA, 559 bp, Homo sapiens
  misc_feature: GZ8MTXP02G2I9K.45.78.H01.1.454.CMB.2.raw
  modified_base (368)..(368): a, c, t, g, unknown or other
  misc_feature (368)..(368): n is a, c, g, or t
tcagacgcgatcgacacgaccggtgctcgatttagtgtgagtagtttggggttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagttggttattcggacgtatggacgtntggggccaaggggaccacggtcaccgtctcctcagcctccacaacgggcccatcggtcctcccctcggccaccctccctaccacgacgcacctcgcgggggcacgacgccggccctcgggcctcgccgtcggttacaaacgggaccttaaccttccgtacgaacgtcgccgtcgtgacgccgggcgtcggg

SEQ ID NO: 355863 - DNA, 514 bp, Homo sapiens
  misc_feature: GZ8MTXP02FVH9R.45.78.H01.1.454.CMB.2.raw
  modified_base (283)..(283): a, c, t, g, unknown or other
  misc_feature (283)..(283): n is a, c, g, or t
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (311)..(311): a, c, t, g, unknown or other
  misc_feature (311)..(311): n is a, c, g, or t
  modified_base (321)..(321): a, c, t, g, unknown or other
  misc_feature (321)..(321): n is a, c, g, or t
  modified_base (328)..(328): a, c, t, g, unknown or other
  misc_feature (328)..(328): n is a, c, g, or t
  modified_base (350)..(350): a, c, t, g, unknown or other
  misc_feature (350)..(350): n is a, c, g, or t
  modified_base (352)..(352): a, c, t, g, unknown or other
  misc_feature (352)..(352): n is a, c, g, or t
  modified_base (375)..(375): a, c, t, g, unknown or other
  misc_feature (375)..(375): n is a, c, g, or t
  modified_base (377)..(377): a, c, t, g, unknown or other
  misc_feature (377)..(377): n is a, c, g, or t
  modified_base (379)..(379): a, c, t, g, unknown or other
  misc_feature (379)..(379): n is a, c, g, or t
  modified_base (381)..(381): a, c, t, g, unknown or other
  misc_feature (381)..(381): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatggagctgagcgagcgnaagganctanacgacacgccgtgatacngtgcgagagnaggatanatttgtagtgtatgagtatggngngtggcgagacgacgcacgtctcncncncncacacgccactcgtctcctcgcacctcctcacgacgcacctcgcggcgacgacgccgccgtcggtcgtcgtcgtcggtacgaacgtacgtaccttaccgtacgtaacgtcgtcgtcgtcgacggcggacgtcg

SEQ ID NO: 355864 - DNA, 506 bp, Homo sapiens
  misc_feature: GZ8MTXP02FRTRY.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacctaacaatgtgcacaaactatgcacagaagtttcagggcagggtcaccatgacagggacacgtccatcagacacagcctacagtggagctgagcgaggcgtagagatcgagaacgacgacggcgtagtattactgtgacgaaggagacgaggtaattacgtagtttaggtaagg

SEQ ID NO: 355865 - DNA, 570 bp, Homo sapiens
  misc_feature: GZ8MTXP02GMBL1.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcgggacggttatgggacgtcgtgggggccaaggggaccacgggtcaccgtctcctcacgccctccaccaacgggcccagtcggtccttcccctggccaccctcctccaagacgccaccgcgtgggggcacgacgccggcccgtgggcctcggccgtcgggtcgaaacgggaccttaccgttccctcgaacgttccgcgtcgtcggacggcgggctcggg

SEQ ID NO: 355866 - DNA, 505 bp, Homo sapiens
  misc_feature: GZ8MTXP02FTELT.45.78.H01.1.454.CMB.2.raw
  modified_base (287)..(287): a, c, t, g, unknown or other
  misc_feature (287)..(287): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtncgacaggcccctggacaagggcttgagtggatggggatggatcaacctaacaagtggtgcaacaaactatgcacagaagttcagggcagggtcacatgacagggacacgtccatcagacacagacctacagtaggacgacgtgacgcgaggctagagatcagacgacgacggcgtgtattacgtgtgcgaagaggacaggtatacgtagtttaggtag

SEQ ID NO: 355867 - DNA, 597 bp, Homo sapiens
  misc_feature: GZ8MTXP02IQ9XD.45.78.H01.1.454.CMB.2.raw
tcagacgcgatcgacacgaccggtgctcgatttagtgtgagtagtttgggtttgggttgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggcgtgagatctagacgacacggccgtgtattactgtgcgagaggcaggaattacgtatttttggagttggttattcggacggttatgggtacgtcgtgggggaccaagggaccacggtcaccgtctccctcacgccctccgaccgaacgggcccacgtccggtccttcccccgtggccctacccctccctaccaacgacgccaccgtccgcgggggccacgcggccggccccgtggggcctcggacccgttgggtaccgaacgggtacctacctttcccgcggaacttccgccgttcgacggcggcgggtcgtcgg

SEQ ID NO: 355868 - DNA, 507 bp, Homo sapiens
  misc_feature: GZ8MTXP02JTNVL.45.78.H01.1.454.CMB.2.raw
  modified_base (464)..(464): a, c, t, g, unknown or other
  misc_feature (464)..(464): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagtcacaggagcccactccccaggtgcagctggtgcagtctgggggctgaggtgaagaagcctggggcctcagtgaaggtctcctgcaaggcttctggatacaccttcaccggctactatatacactgggtgcgacaggccccctggacaagggctgagtggatgggatggatcaacctacaatggtgcacaaactatgcacagtaagttcagggtcagggtcacatgacagggacacgtccatcagcacagcctacagtcggagctgagcgaggctgagatctgacgacacggccgtgtacttacngtgcgaaggacggacgaggtaattacggtagttttaggtaagg

SEQ ID NO: 355869 - DNA, 548 bp, Homo sapiens
  misc_feature: GZ8MTXP02IR301.45.78.H01.1.454.CMB.2.raw
  modified_base (544)..(544): a, c, t, g, unknown or other
  misc_feature (544)..(544): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggcgtgagatctgacgacacggccgtgtattactgtgcgagaggcaggaattacgatttttggagttggttattcggtacggtatgggacgtcgtgggggccaaggggaccacggtcaccgtctcctcagcctccacaacgggcccagtcggtccttccccgtggccaccctcctccacgacgccaccgtctgggggcacgcgcgccgtgggctgcctcggtcaagggtcctacttcctacgtctcgcgtctggacgcgggtcncggg

SEQ ID NO: 355870 - DNA, 512 bp, Homo sapiens
  misc_feature: GZ8MTXP02GIDTQ.45.78.H01.1.454.CMB.2.raw
  modified_base (418)..(418): a, c, t, g, unknown or other
  misc_feature (418)..(418): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatggggatggatcaacctaaccaatggtgcacaaactatgcacagagtttcagggcagggtcacatgacaggacacgtccatcagcacagcctacatgganctgagcgaggctgagatcgtgacgacgacggccgtgtacttacgtcggtgacgaaggacggacgaggtaacgttacggtagtttttaggtaagg

SEQ ID NO: 355871 - DNA, 534 bp, Homo sapiens
  misc_feature: GZ8MTXP02ILLRC.45.78.H01.1.454.CMB.2.raw
  modified_base (407)..(407): a, c, t, g, unknown or other
  misc_feature (407)..(407): n is a, c, g, or t
  modified_base (438)..(438): a, c, t, g, unknown or other
  misc_feature (438)..(438): n is a, c, g, or t
  modified_base (507)..(507): a, c, t, g, unknown or other
  misc_feature (507)..(507): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgtatttttggagttgggttattcggacggttatggggtacgtcgtgggggccaaggggaccacgggtcaccgtcncctcagcctccacacggccatccgtctcccnggccacctctccagcgccacctcgtggggcacgagcggccctggctgccgtggtcaacggctacttccncgaagtcgacgtctgacgcgggctcgg

SEQ ID NO: 355872 - DNA, 577 bp, Homo sapiens
  misc_feature: GZ8MTXP02JSLD3.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagttggttattcggacggtatgggacgtctgggggccaaggggaccacgggtcacccgtctcctcagcctccaccaacgggcccatccggtccttccccctggccaccctccctccaacgacgcaccctcgtcgggggccacgagccggcccgtcggggcctcggccctcgggtcaaacgggaccttaaccgttccctacgtaagtccgccgtcttcggacggccggggctcgggg

SEQ ID NO: 355873 - DNA, 503 bp, Homo sapiens
  misc_feature: GZ8MTXP02HCXVA.45.78.H01.1.454.CMB.2.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (406)..(406): a, c, t, g, unknown or other
  misc_feature (406)..(406): n is a, c, g, or t
  modified_base (416)..(416): a, c, t, g, unknown or other
  misc_feature (416)..(416): n is a, c, g, or t
  modified_base (448)..(448): a, c, t, g, unknown or other
  misc_feature (448)..(448): n is a, c, g, or t
  modified_base (456)..(457): a, c, t, g, unknown or other
  misc_feature (456)..(457): n is a, c, g, or t
  modified_base (459)..(459): a, c, t, g, unknown or other
  misc_feature (459)..(459): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtncgacaggcccctggacaagggcttgagtggatgggatggatcaaaccctanaatggtgccacaaactatgcacagagtttcagggcaggtcacatgaccaggacacgtcatcagcacagccctaanagtggagcgngagacggacgacgacgaggacgacacgagagngcgacganngngacgcgacgacgagaagtagtagtagtagtacgtacgtacgtcg

SEQ ID NO: 355874 - DNA, 529 bp, Homo sapiens
  misc_feature: GZ8MTXP02JAGFE.45.78.H01.1.454.CMB.2.raw
  modified_base (346)..(346): a, c, t, g, unknown or other
  misc_feature (346)..(346): n is a, c, g, or t
  modified_base (492)..(492): a, c, t, g, unknown or other
  misc_feature (492)..(492): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagttagaaagtgggtccatcagtcagcgcagtgatctggacngattcactctcaccatcagcagctgcagctgatgtatttgactaacttatactacgaccaactagtatgtattagttattcggtacgtttcggaccgaagggtaaccaagggttaggaaaacgtacaaaaccggtaacgttacggnggtcctaaggacaaccgtatccgttcgtcttactccg

SEQ ID NO: 355875 - DNA, 528 bp, Homo sapiens
  misc_feature: GZ8MTXP02ING1Z.45.78.H01.1.454.CMB.2.raw
  modified_base (424)..(424): a, c, t, g, unknown or other
  misc_feature (424)..(424): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaaggcttgagtggatgggatggatcaacctaacaagtggtggacacaaactatgacacagtaagttcgagggcagggtcacatgacagggacacgtccatcagacacagcctaacatgganctagagcgaggctaggagatcgacgaacgacgacgggccgttaggtacttacgtaggtcgacggaagacggacagggtaaacttacggttagttttagggtagg

SEQ ID NO: 355876 - DNA, 501 bp, Homo sapiens
  misc_feature: GZ8MTXP02FMDRS.45.78.H01.1.454.CMB.2.raw
  modified_base (406)..(406): a, c, t, g, unknown or other
  misc_feature (406)..(406): n is a, c, g, or t
tcagacgcgatcgacacgaccggtgctcgatttagtgtgagtagtttgggtttggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagtttagaaagtgggtccatcaagtcagcgcagtgatctggacagatcactctcaccatcagcagcctgcagcctgatgatttgactaacttattactgaccaanagtatagattagttattcgacgttcggaccaaagggaccaaaggtaggaaaatacgaaaacgaactgtaggctagcaccatctagtctcattccc

SEQ ID NO: 355877 - DNA, 565 bp, Homo sapiens
  misc_feature: GZ8MTXP02G3OD9.45.78.H01.1.454.CMB.2.raw
  modified_base (534)..(534): a, c, t, g, unknown or other
  misc_feature (534)..(534): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgtatttttggagttggttattcggacgttagtggacgtcgtgggggaccaaggggaccacggtcaccgtctcctcacgcctccacgaacgggcccacgtccggtccttcccccgtggccaccctcctaccaagacgcacctcgtcggggcacgacgccggcccgtgggctcgccgtcggtacaacggtacctaccgtttccncgaactccgcgtcgtgacggcgggcgtcggg

SEQ ID NO: 355878 - DNA, 592 bp, Homo sapiens
  misc_feature: GZ8MTXP02GI2VZ.45.78.H01.1.454.CMB.2.raw
  modified_base (288)..(288): a, c, t, g, unknown or other
  misc_feature (288)..(288): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtcatcagcacagcctacatggagctgagcgaggcgtgagntctgacgacacggccgtgtattacgtgtgcgagaggcgaaggtaattacgtagtttttggagttggttagttcggacggttatgggacgtcggtggggaccgaaggggaccacgggtcaccgtcgtcctcacgcctccgaccgaacgggcccacgtccgtcccttcccccgtcggcccaccccgtccctaccgaacgacgccacccgtcgtcgggggccacgcgccggcccgtgggcctcgccgtcggtaccgaacggtaccttccttccgtcgaacgtcgcgttccgcggacggcggcgtcgg

SEQ ID NO: 355879 - DNA, 496 bp, Homo sapiens
  misc_feature: GZ8MTXP02JCKYA.45.78.H01.1.454.CMB.2.raw
  modified_base (465)..(465): a, c, t, g, unknown or other
  misc_feature (465)..(465): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtctggggctgaggtgaagaagcctggggcctcagtgaaggtctcctgcaaggcttctggatacaccttcaccggctactatatacactgggtgcgacaggccccctggacaagggcttgagtggatgggatggatcaaccctacaatggtgcacaaactatgcacagaagtttcagggcagggtcacatgaccaggacacgtccatcagcacagcctacatggagctagagcgaggcgtgagatctagacgacacggccgtgtacttacngtgcgaagagcaggaatacgtagttttgagg

SEQ ID NO: 355880 - DNA, 557 bp, Homo sapiens
  misc_feature: GZ8MTXP02GTD8F.45.78.H01.1.454.CMB.2.raw
  modified_base (547)..(547): a, c, t, g, unknown or other
  misc_feature (547)..(547): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagaagtttcagggcagggtcacatgaccaggacacgtccatcagcacagcctacatggagctgagcaggctgagatctgacgacacggcgtgtatactgtgcgagaggcaggaaattacgatttttggagttgttagttcggacggttatgggacgtcgtggggaccaaggggaccacggtcaccgtctccgtcacgcctcccaaccgaacgggcccacgtcggtcccttcccccgtcggcccaccctccctaccaacgacgaccaccctcgcggggcaacgcgccggcccgcgggctcgccttggacaacggacctactcctcgaatcgcgtcgngcgcggcgcg

SEQ ID NO: 355881 - DNA, 583 bp, Homo sapiens
  misc_feature: GZ8MTXP02GN6W9.45.78.H01.1.454.CMB.2.raw
tcagacgcgatcgacacgaccggtgctcgatttagtgtgagtagtttgggtttgggttgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagttggttattcggacggttagtggacgtcgtgggggccaaggggaccacggtcaccgtctcctcacgccctcccaccgaacgggcccatccggtccttcccccgtggcccacccctccctcccaacgtacgccaccctccgtcgggggccacgacggccggccctggggcctcggcctcggtccaaacgggtcctaccttcccgtcgaacgtccgtcgtcctggacggtccgggctcgggg

SEQ ID NO: 355882 - DNA, 511 bp, Homo sapiens
  misc_feature: GZ8MTXP02GZHA1.45.78.H01.1.454.CMB.2.raw
  modified_base (355)..(355): a, c, t, g, unknown or other
  misc_feature (355)..(355): n is a, c, g, or t
  modified_base (507)..(507): a, c, t, g, unknown or other
  misc_feature (507)..(507): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagtttagaaagtggggtccatcaaggttcagccggcagtggatctgggacngaatcactctcacatcagcagcctgcagcctgatgatttgactaaacttattactgaccaacagtatgatagttattcgacgttcggaccgaaaggggaccaaagggttaggaaaactacgaaaacgactagtaggctgcacatctgtcttntacc

SEQ ID NO: 355883 - DNA, 540 bp, Homo sapiens
  misc_feature: GZ8MTXP02JD1TZ.45.78.H01.1.454.CMB.2.raw
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
  modified_base (445)..(445): a, c, t, g, unknown or other
  misc_feature (445)..(445): n is a, c, g, or t
  modified_base (477)..(477): a, c, t, g, unknown or other
  misc_feature (477)..(477): n is a, c, g, or t
  modified_base (530)..(530): a, c, t, g, unknown or other
  misc_feature (530)..(530): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagcgngaganctgacgacacggccgtgtattactgtgcgagaggcaggaattacgatttttggagtggttattcggacgtatgggacgtcgtggggaccaagggaccacggtcaccgtctcctcacgcctccaccgacggcctacgtcggtccttcccctcggccnccctcctccacgacgccacctcgcgggcacgngccgccgtgggctgccgtcggacacggtactacttcctcgaacgtcgcgtcgngcgcggcgcg

SEQ ID NO: 355884 - DNA, 543 bp, Homo sapiens
  misc_feature: GZ8MTXP02H5RZ3.45.78.H01.1.454.CMB.2.raw
  modified_base (288)..(288): a, c, t, g, unknown or other
  misc_feature (288)..(288): n is a, c, g, or t
  modified_base (391)..(391): a, c, t, g, unknown or other
  misc_feature (391)..(391): n is a, c, g, or t
  modified_base (401)..(401): a, c, t, g, unknown or other
  misc_feature (401)..(401): n is a, c, g, or t
  modified_base (539)..(539): a, c, t, g, unknown or other
  misc_feature (539)..(539): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagttcagggcagggtcaccatgaccagggacacgtccatcagcacagcctacatggagctgagcaggctgagatcngacgacacggcgtgtattactgtgcgagaggcaggattacgatttggagttggtattcggacggttatggacgtctggggcccaaggggccaggtcaccgtcncctcacgccnccaccaacgggcccactccggtccttcccccgtggccaccctcctccaagcgcacctcgtcggggcacgacgcggcccgtgggctcgcctcggtacgaacggtacctacttccgtcgaacgtcgtcgtcagcgcggcncggg

SEQ ID NO: 355885 - DNA, 501 bp, Homo sapiens
  misc_feature: GZ8MTXP02GHLR9.45.78.H01.1.454.CMB.2.raw
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (469)..(469): a, c, t, g, unknown or other
  misc_feature (469)..(469): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaggtctcctgcaaggcttctggatacaccttcaccggctactatatacactgggtgcgacaggccccctggacaagggcttggagtggatgggatggatcaacctaccaatggtggcacaaactatgcacagagtttcagggcagggtcacatgaccgaggacacgtaccatcagcacagcctacatggagctgagcgaggngngagagcgacgacgacgacgcgtagtacgtacgtgngacgaagagacgagtagtacgttagttagtag

SEQ ID NO: 355886 - DNA, 546 bp, Homo sapiens
  misc_feature: GZ8MTXP02G1SV8.45.78.H01.1.454.CMB.2.raw
  modified_base (282)..(282): a, c, t, g, unknown or other
  misc_feature (282)..(282): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (290)..(290): a, c, t, g, unknown or other
  misc_feature (290)..(290): n is a, c, g, or t
  modified_base (296)..(296): a, c, t, g, unknown or other
  misc_feature (296)..(296): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (312)..(312): a, c, t, g, unknown or other
  misc_feature (312)..(312): n is a, c, g, or t
  modified_base (314)..(314): a, c, t, g, unknown or other
  misc_feature (314)..(314): n is a, c, g, or t
  modified_base (316)..(316): a, c, t, g, unknown or other
  misc_feature (316)..(316): n is a, c, g, or t
  modified_base (353)..(353): a, c, t, g, unknown or other
  misc_feature (353)..(353): n is a, c, g, or t
  modified_base (389)..(389): a, c, t, g, unknown or other
  misc_feature (389)..(389): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagngngagncngacgcncgcngtntcngtgcgngngnagatagatttgagtgttactggaggtatggacgtcgnggggccaaggggaccacgggtcaccgtctcccgtcncgcctccgaccgaccggaccgtacgtccgtcccgtccccgtccgccctaccctccctaccgacgacgaccgtaccgtcgtcgggcgcgcgccgccgtcggcgtcgcgtcgtacgacgtacgtacctccgtcgtcgtcgtcgtcgtcgcgcggcgtcg

SEQ ID NO: 355887 - DNA, 514 bp, Homo sapiens
  misc_feature: GZ8MTXP02HHTF7.45.78.H01.1.454.CMB.2.raw
  modified_base (422)..(422): a, c, t, g, unknown or other
  misc_feature (422)..(422): n is a, c, g, or t
  modified_base (427)..(427): a, c, t, g, unknown or other
  misc_feature (427)..(427): n is a, c, g, or t
  modified_base (482)..(482): a, c, t, g, unknown or other
  misc_feature (482)..(482): n is a, c, g, or t
  modified_base (487)..(487): a, c, t, g, unknown or other
  misc_feature (487)..(487): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatacgaacctaacaagtggtggacaacgaaactatgacaacagaagtttcgagggcagggtcacatgacaggacacgtccagcagcacagcctacntggancagagacgaggcgtagagaagtcagacgacgacggccgtaggttattacgtgtgngaagngacgagaagttagtagttttaggtagg

SEQ ID NO: 355888 - DNA, 519 bp, Homo sapiens
  misc_feature: GZ8MTXP02H5D4R.45.78.H01.1.454.CMB.2.raw
  modified_base (337)..(337): a, c, t, g, unknown or other
  misc_feature (337)..(337): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagatcaccatcacttgccgggcagtcagagtattagtaactggttggcctggtatcagcagaaaccaggaaagcccctaagctcctgctctataggcatctagtttagaaagtgggtccatcagtcagcgcagtgatntgggacagaattcactctcacatcagcagcctgcagacctgatgattttgactaaactttattactgacctaaacagtatagatagtttaagtcgtacgttcgggactaaacggggtaccaagggtaggaaactacgaaaacgtactaggtaggctaaggctaaccatctagttcttactac

SEQ ID NO: 355889 - DNA, 554 bp, Homo sapiens
  misc_feature: GZ8MTXP02GVIDS.45.78.H01.1.454.CMB.2.raw
  modified_base (495)..(495): a, c, t, g, unknown or other
  misc_feature (495)..(495): n is a, c, g, or t
  modified_base (539)..(539): a, c, t, g, unknown or other
  misc_feature (539)..(539): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatggagctgagcgagctgagatctgacgacacggccgtgtattactgtgcgagaggcaggaattacgatttttggagtggttattcggacggtatgggacgtcgtggggccaagggaccacggtcaccgtctcctcacgccctaccaccgaacgggcccagtcggtcctcccccgtggccaccctcctccaagacgccacccgtcgtcgggggccacgacgccggcccgnggggctcgcctcggcaacggacctacttcctcgaatcgcgttcnggacgcgggctacgg

SEQ ID NO: 355890 - DNA, 625 bp, Homo sapiens
  misc_feature: GZ8MTXP02IUXB3.45.78.H01.1.454.CMB.2.raw
  modified_base (285)..(285): a, c, t, g, unknown or other
  misc_feature (285)..(285): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggcgngagatctgacgacacggccgtgtattactgtgcgagaggcaggaaattacgtatttttggagttggttattacgggacggttatggggtacgtcgtcgggggaccaagggggacctacggggtcacccggtctccctcacgccctccaccgaacgggcccagtccggtccttcccccgtggaccctaccctcctaccaacgacgaccaccgtccgcgggggcaacgcggccggcccgtcggggcctcggcccgttcgggtaccgaaacgggtaccttaaccgttccctaccggtaactccggtaccgtttccggtacggtacgggccggggtacgtcggg

SEQ ID NO: 355891 - DNA, 514 bp, Homo sapiens
  misc_feature: GZ8MTXP02JU0FN.45.78.H01.1.454.CMB.2.raw
  modified_base (478)..(478): a, c, t, g, unknown or other
  misc_feature (478)..(478): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttggagtggatgggatggatcaacctaacaatggtggacacgaaactatgacacagaagtttcaggggcagggtacacgatgaccaggacacgtcatcagcactagcctaacagtggagctagagcgaggcgtgaggatcgagacgacgcggcgtgtaacgtcgtcggngacgaagacgacgacgtagtacgttagtttaggtag

SEQ ID NO: 355892 - DNA, 527 bp, Homo sapiens
  misc_feature: GZ8MTXP02I9M6F.45.78.H01.1.454.CMB.2.raw
  modified_base (423)..(423): a, c, t, g, unknown or other
  misc_feature (423)..(423): n is a, c, g, or t
  modified_base (459)..(459): a, c, t, g, unknown or other
  misc_feature (459)..(459): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctggacaagggcttgagtggatgggatggatcaacctaacaatggtgacacaaactatgacaacagtaagttcagggcagggtacaccatcgacgagggacacgtccatcagacacacgcctaanacgtggacgcgtagagcgaggtcgagagtactacgngaacgacgacggccgtagtacgttacgcgtacgacgaagacgacgaagtagtacgttagtttaggtag

SEQ ID NO: 355893 - DNA, 544 bp, Homo sapiens
  misc_feature: GZ8MTXP02HV8S2.45.78.H01.1.454.CMB.2.raw
  modified_base (226)..(226): a, c, t, g, unknown or other
  misc_feature (226)..(226): n is a, c, g, or t
  modified_base (341)..(341): a, c, t, g, unknown or other
  misc_feature (341)..(341): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctnagtgaaggtctcctgcaaggcttctggatacaccttcaccggctactatatacactgggtgcgacacggcccctggacaagggcttgagtggatgggatggatacgaaccctaanaagtggtgacacaaactatgacacgagtaagtttcgagggctagggtcacatagacgagggacacgtccatcagcacagcctacagtagagcgtagagcgaggctggagagtcgtacgacgaccgaacggtccgttagttaacgttacgtagtcgcggaaggaggacgtaacggtaagtttacggtacgtttttaggtaaggg

SEQ ID NO: 355894 - DNA, 538 bp, Homo sapiens
  misc_feature: GZ8MTXP02IIF52.45.78.H01.1.454.CMB.2.raw
  modified_base (285)..(285): a, c, t, g, unknown or other
  misc_feature (285)..(285): n is a, c, g, or t
  modified_base (420)..(420): a, c, t, g, unknown or other
  misc_feature (420)..(420): n is a, c, g, or t
  modified_base (428)..(428): a, c, t, g, unknown or other
  misc_feature (428)..(428): n is a, c, g, or t
  modified_base (432)..(432): a, c, t, g, unknown or other
  misc_feature (432)..(432): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggctcagtgaaggtctctgcaaggcttctggatacaccttcaccggctactatatacactgggtncgacaggcccctggaccaagggcttgagtggatgggatggatacgaaccctaacaagtggtggacaacaaactatgcacagaagtttcgagggcagggtcacatcgacagggacacgtccatcagcacagcctanacgtgganacgngacgcgaggcgtagagtacgtcgtacgacgacgacggtcgtagtacttacgtacggtacgacggaaggacggacgtacggtaagtttacggttagttttacggtag

SEQ ID NO: 355895 - DNA, 505 bp, Homo sapiens
  misc_feature: GZ8MTXP02JHDW0.45.78.H01.1.454.CMB.2.raw
  modified_base (418)..(418): a, c, t, g, unknown or other
  misc_feature (418)..(418): n is a, c, g, or t
  modified_base (435)..(435): a, c, t, g, unknown or other
  misc_feature (435)..(435): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaaggcttgagtggatgggatggatcaaaccctacatggtgcacaaactatgcacagtaagttcgagggcagggtcacatgacgaggacacgtccatcagcacagcctacatgganctagagcgagcgtgagntcgagacgacgacggcctagtactacgtacggtgacgaagagacgaggtaagtagttagtttggttaagg

SEQ ID NO: 355896 - DNA, 516 bp, Homo sapiens
  misc_feature: GZ8MTXP02JHUDK.45.78.H01.1.454.CMB.2.raw
  modified_base (369)..(369): a, c, t, g, unknown or other
  misc_feature (369)..(369): n is a, c, g, or t
  modified_base (443)..(443): a, c, t, g, unknown or other
  misc_feature (443)..(443): n is a, c, g, or t
  modified_base (462)..(462): a, c, t, g, unknown or other
  misc_feature (462)..(462): n is a, c, g, or t
  modified_base (487)..(487): a, c, t, g, unknown or other
  misc_feature (487)..(487): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcgagtgaaggtctcctgcaaggtcttcgtggatacaccttcaccggctactatatacacgtgggtgcgacacggcccctggacgaagggtcttggagtggagtgggatggatacgaaacctaacaagtggtgacacaaactntgacacagtaagtttcgagggcagggtccacgatacgacgagggacacgtccatcagcacagcctagactgganctagagcgagcgagagcangacgacgacgcgtgtaactcgtggngagaagagacgagtagtacgtagttagtg

SEQ ID NO: 355897 - DNA, 554 bp, Homo sapiens
  misc_feature: GZ8MTXP02IY78V.45.78.H01.1.454.CMB.2.raw
  modified_base (249)..(249): a, c, t, g, unknown or other
  misc_feature (249)..(249): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacnctcacttgaattggttcaacagaggccaggcccaatctccaaggcgacctaatttataaggtttctaaaccgggactcgtggggtcccagacagattcagcgcagtggtcaggcactgatttcacactagaaattagagggtgaggctggagatggttgtagtttattcgtgctatgacaaggttacactacgtcggaccgtactacgtttggaccgaggggtaaccagcgtaggaaactacgaaaacgtaaccgtgtacggctcgacctaccatcgtgttcttacacttccttacccgacttac

SEQ ID NO: 355898 - DNA, 494 bp, Homo sapiens
  misc_feature: GZ8MTXP02H0F9E.45.78.H01.1.454.CMB.2.raw
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaacctaacaatggtgcacaaactatgcacagaagtttcaggcagggtcacatgacaggacacgtccatcagcacagctacatgagctgagcgagcgngagangtgacgacgacgcgtagtacttacgtcgtgagaagagacgacgtaagtacgttagtttagtag

SEQ ID NO: 355899 - DNA, 592 bp, Homo sapiens
  misc_feature: GZ8MTXP02HH4QX.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagttggttattcggacggttatgggacgttcgtgggggccaaggggccaacggtcaccgtctcctcacgccctccaccaagggcccagtccggtccttcccccgtggcccacccgtcctaccaacgacgccaccgtcgtcgggggaccacgaggcccggtcccgcggggcctcggccccgtagggtaccaaacgggtacccttacgttacccgttcggaacttcggcgtcgtggacggtcgggcgtcgggg

SEQ ID NO: 355900 - DNA, 535 bp, Homo sapiens
  misc_feature: GZ8MTXP02FGRQ8.45.78.H01.1.454.CMB.2.raw
  modified_base (532)..(532): a, c, t, g, unknown or other
  misc_feature (532)..(532): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatggagctgagcaggctgagatctgacgacacggccgtgtattactgtgcgagaggcaggaattacgatttttggagtggttattcggacggtatggacgtcgtgggggccaaggggaccacgggtcaccgtctcctcagcctccaccaggcccatcgtctcccctggccaccctcctccaagacgcaccctcgtgggggcacgagccggccctggggctgcctggtcgaacggacctactcctcgaactcgcgtctgacgcgggcncgg

SEQ ID NO: 355901 - DNA, 555 bp, Homo sapiens
  misc_feature: GZ8MTXP02HW0IM.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagttggttattcggacggttatgggacgtcgtggggccaaggggacacggtcaccgtctcctcacgcctccgaccaacgggcccagtccggtccttccccgtcggcccaccctccctaccaacgacgccaccgtcgcgggggcacgacgcggccctcggggctcgcctggtcaacggtactacttcctcgaagttcgcgttcagcgcggctcgg

SEQ ID NO: 355902 - DNA, 551 bp, Homo sapiens
  misc_feature: GZ8MTXP02FSZFL.45.78.H01.1.454.CMB.2.raw
  modified_base (541)..(541): a, c, t, g, unknown or other
  misc_feature (541)..(541): n is a, c, g, or t
  modified_base (550)..(550): a, c, t, g, unknown or other
  misc_feature (550)..(550): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatgggacgtcgtgggggccaaggggaccacgggtcaccgtctccctcacgcctccaccaacggggcccacgtcggtccttccccctggcccaccctccctccaacgacgccaacccgttcgcgggggcacgacgcggcccgtgggcctggcctggtcaacggctactctcgaatcgcgtcgngcgcggcgng

SEQ ID NO: 355903 - DNA, 524 bp, Homo sapiens
  misc_feature: GZ8MTXP02FY43M.45.78.H01.1.454.CMB.2.raw
  modified_base (445)..(445): a, c, t, g, unknown or other
  misc_feature (445)..(445): n is a, c, g, or t
  modified_base (495)..(495): a, c, t, g, unknown or other
  misc_feature (495)..(495): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacacgtgggtgcgacagggcccctggacaaggcttgagtggatgggatggatacgaaaccctaaccaagtggtggacaacaaaactatgacacaagaacgtttcgaggggcaggggtcaccgatcgacagggacacgtccatcacgacacgacgacctacgagtggancgtagacgcgagtcgagagacgtcgagacgcgacggcgtagtatacgtgngagaagagacgagtatacgtagtttgtag

SEQ ID NO: 355904 - DNA, 521 bp, Homo sapiens
  misc_feature: GZ8MTXP02H764Y.45.78.H01.1.454.CMB.2.raw
  modified_base (225)..(225): a, c, t, g, unknown or other
  misc_feature (225)..(225): n is a, c, g, or t
  modified_base (430)..(430): a, c, t, g, unknown or other
  misc_feature (430)..(430): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctnagtgaaggtctcctgcaaggcttctggatacaccttcaccggctactatatacactgggtgcgacacggcccctggacaaggggcttgagtgggatgggatggatcaacctaacaatggtggacaacaaactatgacacagtaagtttcgagggcagggtcacgatgaccgagggacacgtccatcagcacagcctacagtggancgtagagcggagtcggacgaaggcgtcgtagacggacgacggccgtagtattacgcgtagagaagacgacgacgagtacgtagtttagtag

SEQ ID NO: 355905 - DNA, 534 bp, Homo sapiens
  misc_feature: GZ8MTXP02GEQ6B.45.78.H01.1.454.CMB.2.raw
  modified_base (312)..(312): a, c, t, g, unknown or other
  misc_feature (312)..(312): n is a, c, g, or t
  modified_base (441)..(441): a, c, t, g, unknown or other
  misc_feature (441)..(441): n is a, c, g, or t
  modified_base (461)..(461): a, c, t, g, unknown or other
  misc_feature (461)..(461): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattacngtgcgagaggcaggaattacgatttttggagtggttattcggacggttatgggacgtcgtggggccaaggggaccacgggtcaccgtctcctcacgcctccaccaagggcccatcgtctcccctggccnccctcctcagacgcacctcncggggcacagcgccctcgggctgccgtcggtcaacggactacttcctcgaacgtcgcgtctcgacgcggctgg

SEQ ID NO: 355906 - DNA, 508 bp, Homo sapiens
  misc_feature: GZ8MTXP02IAIO9.45.78.H01.1.454.CMB.2.raw
  modified_base (435)..(435): a, c, t, g, unknown or other
  misc_feature (435)..(435): n is a, c, g, or t
  modified_base (448)..(448): a, c, t, g, unknown or other
  misc_feature (448)..(448): n is a, c, g, or t
  modified_base (485)..(485): a, c, t, g, unknown or other
  misc_feature (485)..(485): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtctggggctgaggtgaagaagcctggggcctcagtgaaggtctcctgcaaggcttctggatacaccttcaccggctactatatacactggtgcgacaggccccctggacaagggcttgagtgggatgggatggatcgaaaccctaaccaaagtggtggacacgaaaactatgacaacagaagtttcagggcagggtcaccatgaccagggacacgtccatcagcacagcctacatgagcngagcgagctgagntcagacgacgacggccgtgtacttactgtgacgaagngcaggattacgtatttttggagg

SEQ ID NO: 355907 - DNA, 563 bp, Homo sapiens
  misc_feature: GZ8MTXP02J139F.45.78.H01.1.454.CMB.2.raw
  modified_base (484)..(484): a, c, t, g, unknown or other
  misc_feature (484)..(484): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgctacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggcgtgtattactgtgcgagaggcaggtaattacgtatttttggagttggtttattcggacggttagtgggacgtcgtgggggaccaagggaccacgggtcaccgtctcctcacgccctccgacgaacgggcccagtccggtccttcccccgtggccgccctcgcctcgaggacgcaccgtcggnggggaccacgcgccggccctcggggctcgccgtaggcacggacctacttcccgcgacgtcgcgttacgcggcggcggcg

SEQ ID NO: 355908 - DNA, 528 bp, Homo sapiens
  misc_feature: GZ8MTXP02HEUA9.45.78.H01.1.454.CMB.2.raw
  modified_base (331)..(331): a, c, t, g, unknown or other
  misc_feature (331)..(331): n is a, c, g, or t
  modified_base (458)..(458): a, c, t, g, unknown or other
  misc_feature (458)..(458): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaanaatggtgaccacaaactatgcacagagttcagggcagggtcacatgacaggacacgtcatcagcacagcctacatggagctaggagcgaggctagagatcgtagacgacgacggcgtagtattacgngtcgacggagaggacgtaaggtaagtttacgtagtttttagggagtttaggtttacgttacgggtaacgg

SEQ ID NO: 355909 - DNA, 526 bp, Homo sapiens
  misc_feature: GZ8MTXP02IK3AM.45.78.H01.1.454.CMB.2.raw
  modified_base (401)..(401): a, c, t, g, unknown or other
  misc_feature (401)..(401): n is a, c, g, or t
  modified_base (504)..(504): a, c, t, g, unknown or other
  misc_feature (504)..(504): n is a, c, g, or t
tcagacgcgatcgacacgaccggtgctcgatttagtgtgagtagtttgggtttgggtgaagaagcctgggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtattactgtgcgagaggcaggaaattacgatttttggagtggttattcggacggttatgggacgtcgtgggggccaaggggccacgggtcaccgtcncctcagcctccacacgggccatcggtctcccctggccaccctcctccagacgccacctctgggggcacgagccggccctgggctgcctggtcaggctacttcncgaatcgcgtctgcgcggctgg

SEQ ID NO: 355910 - DNA, 536 bp, Homo sapiens
  misc_feature: GZ8MTXP02IWXSJ.45.78.H01.1.454.CMB.2.raw
  modified_base (267)..(267): a, c, t, g, unknown or other
  misc_feature (267)..(267): n is a, c, g, or t
  modified_base (333)..(333): a, c, t, g, unknown or other
  misc_feature (333)..(333): n is a, c, g, or t
  modified_base (338)..(338): a, c, t, g, unknown or other
  misc_feature (338)..(338): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtatagtactggtgctggtatcagcagaacaggaaacncccctaagctcctgctctataggcatctagttagaagtgggtccatcaggtcagcgcagtgatcgnggacngattcactctcacatcagcagctgcagctgattgtatttgacttaaacgtttatttacctagtacctaaacgtagttaatagtatttagtttacttacggtacgttacggaccgaaagggtaaccgtaagggtacgaaaactaccgaaaacgtacgtaggtacggctaagacctaactatcgttagttccttactacg

SEQ ID NO: 355911 - DNA, 597 bp, Homo sapiens
  misc_feature: GZ8MTXP02GSC4E.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagaagtttcagggcagggtcaccatgaccagggacacgtccatcagcacagcctacatggagctgagcaggctgagatctgacgacacggcgtgtattacgtgtgcgaggaggacaaggtaaattacgtagtttttgggagttaggttagttcggggacggttagtggggtacgtcggtcgggggaccaaacggggaccacgggtccaccgtctcctcacgccctaccaccgaacgggcccacgtccggtccttcccccgtggcccaccctcctaccaacgacgaccaccgtcgtcggggcacgacgccggcccgtcggctcgccgtcggtacaacggtactaccgttccgtacgtaacgtcggcgtcgtggacggcggacgtcgg

SEQ ID NO: 355912 - DNA, 565 bp, Homo sapiens
  misc_feature: GZ8MTXP02IVXJ2.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagttggttagttcggacggttatgggacgtcgtggggccaagggaccacgggtcaccgtctccctcacgccctcccgacccaacgggcccaacgtccggtccttcccccgtcggccaccctccctccaacgcgcacctcgtcgggggcacgacgccggcccgtggccgtgccgtcggtacaacggactacgtcctacgcgtcgcgtctcgacgcgggctcggg

SEQ ID NO: 355913 - DNA, 533 bp, Homo sapiens
  misc_feature: GZ8MTXP02JZW2R.45.78.H01.1.454.CMB.2.raw
  modified_base (415)..(415): a, c, t, g, unknown or other
  misc_feature (415)..(415): n is a, c, g, or t
  modified_base (432)..(432): a, c, t, g, unknown or other
  misc_feature (432)..(432): n is a, c, g, or t
  modified_base (444)..(444): a, c, t, g, unknown or other
  misc_feature (444)..(444): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacactcacttgaattggtttcaacagaggccaggccaatctccaaggcgcctaaatttataaggtttctaaccgggactcgtggggtcccagacagattcagcgccagtgggtcaggcactgatttcacactgaaaattgagggtgagctgagatgttggagtttattntgcatgacaaggtacanactggaccgtanacgtttggaccaggggaccaaggctaggaaaacttacaaaacgaactgtaggctacgaccaccatcctgtcttcactccttcccgctac

SEQ ID NO: 355914 - DNA, 588 bp, Homo sapiens
  misc_feature: GZ8MTXP02HR6QW.45.78.H01.1.454.CMB.2.raw
  modified_base (395)..(395): a, c, t, g, unknown or other
  misc_feature (395)..(395): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggataggaaacactcacttgaattggttcaacagaggccaggccaatctacaagcacctaatttataagttctaaccggctcgtcgggtacccagacagatcagcgcaggtggtcaggcactgatttcaacactagtaaaagttggtagggtggagngtaggaggagtggtttaggttagttttatttcgtgactagtgacgtaaaggtacacgtacgtcggtaccgtacttacgtttacggaccgtaagggggaaccaaggaccgtagggaaaactacgaaaacgtaacgtggtacggtactacgacacctatccgttacgtacttacacttcccttacccgaccttac

SEQ ID NO: 355915 - DNA, 556 bp, Homo sapiens
  misc_feature: GZ8MTXP02GCD4I.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacgttatgggacgtcgtgggggcctaaggggaccacgggtcaccgtctcctcagcctccaccacgggcccagtcggtccttccccgtggccaccctccctccaacgacgccacccgtcgtcgggggcaccgacgcggcccgtgggcctcggcctcggtcaacgggtcctactccgtcgaacgtcgcgtctgacgcggcgtcgg

SEQ ID NO: 355916 - DNA, 528 bp, Homo sapiens
  misc_feature: GZ8MTXP02FJ2A6.45.78.H01.1.454.CMB.2.raw
  modified_base (272)..(272): a, c, t, g, unknown or other
  misc_feature (272)..(272): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcaggctgagatctgacgacacggccgtgtattactgtgcgagaggcaggaattacgatttttggagtggttattcggacggtatggacgtctggggccaagggaccacgggtcaccgtctcctcagcctccaccaagggcccatcggtccttccccctggccaccctcctccaagacgcacctctgggggcacgagcgcctgggctgcctggtcaacggctactcctccgaatcgcgtctgacgcggctgg

SEQ ID NO: 355917 - DNA, 502 bp, Homo sapiens
  misc_feature: GZ8MTXP02IROUS.45.78.H01.1.454.CMB.2.raw
  modified_base (420)..(420): a, c, t, g, unknown or other
  misc_feature (420)..(420): n is a, c, g, or t
  modified_base (433)..(433): a, c, t, g, unknown or other
  misc_feature (433)..(433): n is a, c, g, or t
  modified_base (442)..(442): a, c, t, g, unknown or other
  misc_feature (442)..(442): n is a, c, g, or t
  modified_base (472)..(472): a, c, t, g, unknown or other
  misc_feature (472)..(472): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctgggggctgaggtgaagaagcctggggcctcagtgaaggtctcctgcaaggcttctggatacaccttcaccggctactatatacactgggtgcgacaggcccctggacaaggctgagtggatgggatggatcaacctaacaatgtgcacaaactatgcacagaagtttcgagggcagggtcaccatgaccgagggacacgtccatcagcacagcctacatgganctagagcgagcgngagagtacngacgacgacggccgtagtattacgtcgtgngaagagcgagtagtacgtagtttagttagg

SEQ ID NO: 355918 - DNA, 537 bp, Homo sapiens
  misc_feature: GZ8MTXP02JEIVA.45.78.H01.1.454.CMB.2.raw
  modified_base (374)..(374): a, c, t, g, unknown or other
  misc_feature (374)..(374): n is a, c, g, or t
  modified_base (444)..(444): a, c, t, g, unknown or other
  misc_feature (444)..(444): n is a, c, g, or t
  modified_base (451)..(451): a, c, t, g, unknown or other
  misc_feature (451)..(451): n is a, c, g, or t
  modified_base (504)..(504): a, c, t, g, unknown or other
  misc_feature (504)..(504): n is a, c, g, or t
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggacgcccactcccaggtgcagctggtgcagtctggggctgaggtgaagagccgtggggcctcagtgaaggtctcctgcaggcttctggatacaccttcaccggctactatataccacgtgggtcgcgacacgggccccctggacaagggcttggagtgggatggggatgggataccgaaacccctaacaagtgggtaggacaacaaactntgcaacaagtaagtttcgaggggcagggtccacagtcgaccgagggacacgtcatcagcacgagccctanagtggancgtagagcgaggtcgagaggactcgacggacgacgacggccgtagtattacgngtcgagaagagacgagtagtacgtagttagtag

SEQ ID NO: 355919 - DNA, 622 bp, Homo sapiens
  misc_feature: GZ8MTXP02JHIJ0.45.78.H01.1.454.CMB.2.raw
  modified_base (312)..(312): a, c, t, g, unknown or other
  misc_feature (312)..(312): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattacngtgcgagaggcaggtattacgatttttggagtggttagtcggacgtagtggacgtcgtggggaccgaagggacacggtcacccgtctccctcacgccctaccaccgaacggggcccacgtccgggtcccttcccccgtacggccctaccctccctaccgaacgaccggaccacccgttcggtcgggggaccaacgacggccggtccccgttggggccgttcggccgtcgggtaccgaaacgggtaccttaccgttcccgttacgaacgttcccggtacggttccgtggaccggtccggggtacgtcgggg

SEQ ID NO: 355920 - DNA, 508 bp, Homo sapiens
  misc_feature: GZ8MTXP02FU9H6.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctgggggctgaggtgaagaagcctggggcctcagtgaaggtctcctgcaaggcttctggatacaccttcaccggctactatatacactgggtgcgacaggcccctggacaagggcttgagtggatggggatggatcgaaccctaacaagtggtggacacgaaactatgcacagtaagtttcagggcagggtcacatgacagggacacgtccatcagacacagcctacagtggagctgagcgaggctagagatctgacgacgacggccgtgtatactgtgcgaagaggcgaggtaattacgtagtttggtaagg

SEQ ID NO: 355921 - DNA, 517 bp, Homo sapiens
  misc_feature: GZ8MTXP02GIPLZ.45.78.H01.1.454.CMB.2.raw
  modified_base (486)..(486): a, c, t, g, unknown or other
  misc_feature (486)..(486): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggccccctggacaaggcttgagtggatggggatgggatacaaccctaaccaatggtggacaacaaactatgcaacagaagtttcgagggtcagggtcaccgatgaccagggacacgtaccatcagacacagcctacagtggagcgtagagcaggctagagatcgtagacgacgacggccgtagtactactgtgngaaggagacgaggattacgtagtttggtagg

SEQ ID NO: 355922 - DNA, 587 bp, Homo sapiens
  misc_feature: GZ8MTXP02GUBFD.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtcatcagcacagcctacatggagctgagcaggctgagatctgacgacacggccgtgtattactgtgcgagaggcaggaattacgtatttttgggagttggttagttcgggacggttagtgggtacgtcgtggggaccaaggggaccgacggtcaccgtctccctcacgccctcccgaccgaacgggcccacgtccggtccttcccccgtggccctacccgtcccttaccaacgacgccaccgtcgtcgggggcacgacggccggccgcgggctcggccgtcggtccaaacgggtcctacgttccgtacgaacgtccgcgttctggacgcgggctacggg

SEQ ID NO: 355923 - DNA, 551 bp, Homo sapiens
  misc_feature: GZ8MTXP02I3O53.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagttggttattcggacggttatgggacgtcgtggggccaaggggaccacggtcaccgtctcctcagcctccaccaacgggcccatcggtcctcccctggccaccctcctccaacgcgccaccctcgtcgggggcacgacgcggcccgtgggcctcgccgtcggtcaaacgggcctacttcctcgaacgtcgcgtctgacgcgggctcggg

SEQ ID NO: 355924 - DNA, 514 bp, Homo sapiens
  misc_feature: GZ8MTXP02HEK9O.45.78.H01.1.454.CMB.2.raw
  modified_base (428)..(428): a, c, t, g, unknown or other
  misc_feature (428)..(428): n is a, c, g, or t
  modified_base (431)..(431): a, c, t, g, unknown or other
  misc_feature (431)..(431): n is a, c, g, or t
  modified_base (436)..(436): a, c, t, g, unknown or other
  misc_feature (436)..(436): n is a, c, g, or t
  modified_base (439)..(440): a, c, t, g, unknown or other
  misc_feature (439)..(440): n is a, c, g, or t
  modified_base (444)..(444): a, c, t, g, unknown or other
  misc_feature (444)..(444): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
  modified_base (489)..(489): a, c, t, g, unknown or other
  misc_feature (489)..(489): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggccgagatctgacgacacggccgtgtattactgtgcgagaggcaggaattacgattttggagtggttatcggacggtatgggacgtcgtgggggccaaggggaccacggtcacccgtctcctcagcctcaccaggcccatcgctcccngcncctcncanncacncngggcacgngcgcctggctcgcctggtcaacggactacgttccncgatcgcgtctcgagcggctggacg

SEQ ID NO: 355925 - DNA, 633 bp, Homo sapiens
  misc_feature: GZ8MTXP02F7KCW.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcacatgaccaggacacgtccatcagcacagcctacatggagctgagcaggctgagatctgacgacacggccgtgtattactgtgcgagagcaggaattacgatttttggagtggttattcggacggttatgggacgtcgtagggggaccaaggggtaccacgggtccacccgtctcctcacgccctcccgaccaacgggcccagtccggtccttcccccgtggcccacccctccctacccgaacgacggccaacccgtccgtcgggggccaccgacggccggtcccccgtcgggggcctcggcccgtcgggttaccgaaacggggtaccgttaaccctttccgttacccgaacgtttcccggccggtttacccggtacggtacgggtccggggtaccggtcggg

SEQ ID NO: 355926 - DNA, 538 bp, Homo sapiens
  misc_feature: GZ8MTXP02FVUL9.45.78.H01.1.454.CMB.2.raw
  modified_base (481)..(481): a, c, t, g, unknown or other
  misc_feature (481)..(481): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtgcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggttatggacgtctggggtccaagggaccacgggtcaccgtctcctcagcctccaccaaggcccatcggtccttccccctggccacccgtcctccaagacgcaccctctgggggcacagcgcccgngggctcgcctcggtcaacgggactacttcctcgaacgtcgcgtctgagcgggctcgg

SEQ ID NO: 355927 - DNA, 611 bp, Homo sapiens
  misc_feature: GZ8MTXP02FWSKW.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgagtttttggagtggttagttcggacggttatgggacgtcgtgggggccaaggggaccacggtcaccgtctcctcagccctccaccgaacgggcccacgtccgggtccttcccccgtggcccaaccccgtccctacccgaacgacgcccaacccgttcgcgggggaccaccggacgccggccccgtggggcctcggacctcgggtaccaaacgggtaccttaaccgttcctaccggtaacgtccggtccgttcgtcggaacgggtccgggccgtcgggg

SEQ ID NO: 355928 - DNA, 537 bp, Homo sapiens
  misc_feature: GZ8MTXP02HMMO4.45.78.H01.1.454.CMB.2.raw
  modified_base (366)..(366): a, c, t, g, unknown or other
  misc_feature (366)..(366): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtctggggctgaggtgaagaagcctggggcctcagtgaaggtctcctgcaaggcttctggatacaccttcaccggctactatatacactgggtgcgacaggcccctggacaaggcttgagtggatgggatggatcaacctaacaatggtaggacaacaaaactatgaccaanagaagttcagggcagggtacaccatgaccgagggacacgtaccaanacanacacacgacctaagagtaggacgcgagacgacgacgcgagagactacgacgacgacgacggtcgtagtactacgtacgtagacggaagtacgacgaacggtaattacgttagtttaggagg

SEQ ID NO: 355929 - DNA, 669 bp, Homo sapiens
  misc_feature: GZ8MTXP02JFS3E.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgtagtttttggagttgttattcggacggttatggacgtcgtggggccaaggggaccacggtcaccgtctcctcgacgcctcccgaccaacggggccctacgtccgggtcccttcccccgtcgggccctaccccgttcccgtacccgaaaccgacggtacccaaccccgtccggttacggggggccacggaaccggcccgggtccccgtcgggggcccttcggccccgttacgggttaccccgaaacgggtacccgttaacccgtttccccgtaccggtaacgttcccgggtcccggttaccgtcgggtaccgggtcccgggggtacgttcccggggg

SEQ ID NO: 355930 - DNA, 528 bp, Homo sapiens
  misc_feature: GZ8MTXP02FZ37A.45.78.H01.1.454.CMB.2.raw
  modified_base (473)..(473): a, c, t, g, unknown or other
  misc_feature (473)..(473): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggttatgggacgtcgtgggggccaaggggaccacgggtcaccgtctcctcagcctccaccaacgggcccatcggtctcccctggccaccctcctccaagacgcacctctggggcacngcgcctggctgcctggtcaaggctacgtcctcgaatcgcgtctgacgcggctcgg

SEQ ID NO: 355931 - DNA, 602 bp, Homo sapiens
  misc_feature: GZ8MTXP02FW7SC.45.78.H01.1.454.CMB.2.raw
  modified_base (272)..(272): a, c, t, g, unknown or other
  misc_feature (272)..(272): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcgaggctgagatctgacgacacggccgtgtattactgtgcgaggaggcaggtaattacgatttttaggagttggttattcgggacggttatggggacgtcgtgggggacccaaggggtaccacgggtcaccgtctcctcacgcctccaccgaacggcccagtcgtcctccccgtaggccaccctcctaccaacgacgccacccgtcgtcgggggcacgcgccggccccgtgggccctcggcccgtgggtacaaacgggtaccttaaccgttcccgttaaccggaacttccggccgttacgtcgacgggtccggggacgtccgggg

SEQ ID NO: 355932 - DNA, 538 bp, Homo sapiens
  misc_feature: GZ8MTXP02JOEKT.45.78.H01.1.454.CMB.2.raw
  modified_base (373)..(373): a, c, t, g, unknown or other
  misc_feature (373)..(373): n is a, c, g, or t
  modified_base (447)..(447): a, c, t, g, unknown or other
  misc_feature (447)..(447): n is a, c, g, or t
  modified_base (462)..(462): a, c, t, g, unknown or other
  misc_feature (462)..(462): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggcgtgagatctagacgacacggccgtgtattactgtgcgagaggcaggaattacgatttttggagttggttattcggacggttatgggactntgggggccaaggggccagggtcaccgtctccgtcagcctccacacggccgactcggtctccctcggcacctccnccacgacgcacctcncgggcgacgacgcgccgcggcgtcgccgtcggtcgacggacgtactccttcgtccgtccgcgtcgcgcggcgcgcg

SEQ ID NO: 355933 - DNA, 594 bp, Homo sapiens
  misc_feature: GZ8MTXP02HXKQO.45.78.H01.1.454.CMB.2.raw
  modified_base (507)..(507): a, c, t, g, unknown or other
  misc_feature (507)..(507): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctagacgacacggccgtgtattactgtgcgagaggcaggattacgattttgagtgtatcggacgtatggactcgtgggccgaagggccaggtccaccgtctccctcgacgccctccaccgaacgggccctacgtccgggttccttcccccgtggtcccacccctcccttaccaacgacgcctacccgttcgtcgggggccacgacggccggtccccgngggggtcctcggccgttcggtacgaaacgggtaccgtaccttccgtcgtaacgttccggacgtcgtcggacgccggggtacgtcggg

SEQ ID NO: 355934 - DNA, 560 bp, Homo sapiens
  misc_feature: GZ8MTXP02GLNPB.45.78.H01.1.454.CMB.2.raw
  modified_base (433)..(433): a, c, t, g, unknown or other
  misc_feature (433)..(433): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctggacaagggcttgagtggatgggatggatcaaaccctaacaagtggtggacacaaaactatgcaacagtaagtttcagggcaggggtcaccgatgaccagggacacgtccatcagcacagacctacatcgganacgtgacgcgagggctaggagaactcgtacggaaccggaaccgaccgggccggttaggttaactttaccgtcgtaggacggaaggaggacgaaggtaaagtttacggttaaggtttttaggtaaggg

SEQ ID NO: 355935 - DNA, 534 bp, Homo sapiens
  misc_feature: GZ8MTXP02F6FRA.45.78.H01.1.454.CMB.2.raw
  modified_base (287)..(287): a, c, t, g, unknown or other
  misc_feature (287)..(287): n is a, c, g, or t
  modified_base (361)..(361): a, c, t, g, unknown or other
  misc_feature (361)..(361): n is a, c, g, or t
  modified_base (497)..(497): a, c, t, g, unknown or other
  misc_feature (497)..(497): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtncgacaggcccctggacaaggcttgagtggatggggatggatacaaaccctaacaagtggtggacaacaaaactntgacaacgagtaagtttcgagggcagggtcaccatcgacgagggacacgtccatcagacacacgcctaacagtgggagactaggagcgaggcgtagacgagtcgtagaaccgacgacggtcgtagtattacgtggngacgaaggacgacgagtaagttacgtagtttaggtag

SEQ ID NO: 355936 - DNA, 564 bp, Homo sapiens
  misc_feature: GZ8MTXP02IX2DU.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaatacgatttttggagtggttattcggacggttatgggacgtcgtgggggccaaggggccacgggtcaccgtctcctcagcctcaccgagggcccatccggtcctcccctcggccaccctcctccaagcgccacctcgtcgggggccacgacgccggcccgtgggcctcgccgtcgggtaccaaacgggaccttaccgttccctcgaacgtccggcgtctcggcggccggggctcggg

SEQ ID NO: 355937 - DNA, 657 bp, Homo sapiens
  misc_feature: GZ8MTXP02IMGPP.45.78.H01.1.454.CMB.2.raw
  modified_base (311)..(311): a, c, t, g, unknown or other
  misc_feature (311)..(311): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagtttcagggcagggtcaccatgaccagggacacgtccatcagcacagcctacatggagctgagcgaggctgagatctgacgacacggccgtgtattangtgcgagaggcaggattacgtagttttggagttggttagttcggacggttatcgggtacgtcgtgggggaccgaaggggaccacgggtccaccgtcctcctcgacgccctcccgaacccgacggggcccctagtcccggtcccttccccccgtcggtaccctacccccttcccgtacccgaagaccggacctaacccgtccggtcgggggacccaccggacgcccggggccccgtcggggcctccggtccggtacgggttaccgaaacgggtaccgttaacccttcccgttacgaaccgtttccggaccggtttccgcggtaccgggccggggtaccgtccggggg

SEQ ID NO: 355938 - DNA, 524 bp, Homo sapiens
  misc_feature: GZ8MTXP02JDSOX.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggctctggatacaccttcaccggctactatatacactgggtgcgacaggcccctggacaaggctgagtggatggatggatcaacctaacaagtggtaggacaacgaaactatgacaacagtaagtttcgagggcaggggtacacgatcgacgagggacacgtccagcagcacacgcctacagtggacgctagacgcgaggctagagatcagacgacgacggccgtagtacttacgtgtgacgaagtacggacgacggtaagtacgtagttttaggtaggg

SEQ ID NO: 355939 - DNA, 564 bp, Homo sapiens
  misc_feature: GZ8MTXP02JOTRY.45.78.H01.1.454.CMB.2.raw
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
  modified_base (508)..(508): a, c, t, g, unknown or other
  misc_feature (508)..(508): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcgagcgtgagntctgacgacacggcgtgtatactgtgcgaggagcgaggaattacgtattttgggagttcggttagttcggaggtatcgggtacgttgtcgggggaccaaggggaccacgggtcaccgtcctcctcacgccctccgaccgaacgggccctacgtccggtccttcccccgtggccctaccctcctaccacgacgccaccgtcgcggggcacgcggcgcccgnggcgtcgcgcgacgacgtactaccgtccgtcgtcgtcgcgtcgcggcgcggcgtcg

SEQ ID NO: 355940 - DNA, 536 bp, Homo sapiens
  misc_feature: GZ8MTXP02HTQ65.45.78.H01.1.454.CMB.2.raw
  modified_base (514)..(514): a, c, t, g, unknown or other
  misc_feature (514)..(514): n is a, c, g, or t
  modified_base (527)..(527): a, c, t, g, unknown or other
  misc_feature (527)..(527): n is a, c, g, or t
  modified_base (535)..(535): a, c, t, g, unknown or other
  misc_feature (535)..(535): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtcgtggggccaaaggggccacgggtcaccgtctcctcagcctccaccaacgggcccatccggtccttcccccgtggcccaccctcctccaagcgccacctcgcgggggcacgacgcggccctgggctcgcctgtcaaggctacttccncgaatcgcgtcgngcgcggcng

SEQ ID NO: 355941 - DNA, 659 bp, Homo sapiens
  misc_feature: GZ8MTXP02G5IG9.45.78.H01.1.454.CMB.2.raw
  modified_base (280)..(280): a, c, t, g, unknown or other
  misc_feature (280)..(280): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccacctgtctgcatctgtaggagacagagtcaccatcacttgccgggcagtcagagtattagtaactggttgcctggtatcagcagaacacgaagaccacagctcgnctataagacgatatacgtttaagtaaagtaagggtccggtactagtagtacgtcgacggtccgagtaggtagtcttcggaggacgaagttactacctacctcctaccaacttacacgacgaacgtaccgcgtacgacgaccgtaccgtagtagttagtttacgtttacaaaactttactttaaacttacggtaccgaaacctaaaggttaattacgtaagttaagtttagttacgttaccggtaaccgttaccgaaaacgggtaaacggtaacggttaaagggtaaacgtaaaacgtaaaccgtaaaaacggtcgttacgggtaccgtaacggtaccgaacccttaaacggctttaccgtaccggtttaccttaacccg

SEQ ID NO: 355942 - DNA, 517 bp, Homo sapiens
  misc_feature: GZ8MTXP02H4FH7.45.78.H01.1.454.CMB.2.raw
  modified_base (450)..(450): a, c, t, g, unknown or other
  misc_feature (450)..(450): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
tcagacgcgatcgacacgaccggtgctcgatttagtgtgagtagtttgggtttgggggagcatcacccagcaaccacatctgtcctctagagaatcccctgagagctcccgttcctcaccatggactggacctggaggatcctcttcttggtggcagcagccacaggagcccactcccaggtgcagctggtgcagtctggggctggaggtgaagaagccgtggggcctcagtgaaggtctcctgcaaggcttctggatacaccttcaccggctactatatacactgggtgcgacacggcccctggaccaagggcttggagtggatgggatggatcaacctaacaagtggtggacacaaaacttatgacaacagtaagtttcgagggcagggtcacatgacagggacacgtcatcagcacacgcctacagtggagcgtgacgcgacggcgngaagatcgagacgacgacggcgtagtatacgtggngngaagagacgagtagtacgttagtttagtag

SEQ ID NO: 355943 - DNA, 590 bp, Homo sapiens
  misc_feature: GZ8MTXP02F8FBV.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcacatgaccagggacacgtccatcagcacagcctacatggagctgagcgaggctgagatctgacgacacggccgtgtattactgtgcgagaggcaaggtaattacgtatttttggagttggttattcggacgttagtgggacgtcgtgggggaccaaggggaccacgggtcaccgtctcctcacgccctccaccgacgggcccacgtccggtccttcccccgtcggcccaccctccctaccaacgacgccacccgtcgtcgggggccacgacggccggcccgtgggccgtcgccgtcggtacaaacggtacctaccgttcccgtacgaacgttcgccgtacgtcgacggcgggtcgtcggg

SEQ ID NO: 355944 - DNA, 524 bp, Homo sapiens
  misc_feature: GZ8MTXP02FM65C.45.78.H01.1.454.CMB.2.raw
  modified_base (436)..(436): a, c, t, g, unknown or other
  misc_feature (436)..(436): n is a, c, g, or t
  modified_base (442)..(442): a, c, t, g, unknown or other
  misc_feature (442)..(442): n is a, c, g, or t
  modified_base (452)..(452): a, c, t, g, unknown or other
  misc_feature (452)..(452): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagcgtgagatctagacgacacggccgtgtattactgtgcgagaggcaggaattagattttggagtgtattcggagtatggacgtgtggggcaagggacacgggtcaccgtctccgtcacgcctccaccaacggccactcggtcctcccctcggcccncctccnccacgacgcncgcgcggcgcgcgcgccgcggcgcgcgtcgcgacgtactacctccgtcgcgtcgtcgtcgtcgcgcggcgcg

SEQ ID NO: 355945 - DNA, 571 bp, Homo sapiens
  misc_feature: GZ8MTXP02I94P9.45.78.H01.1.454.CMB.2.raw
  modified_base (446)..(446): a, c, t, g, unknown or other
  misc_feature (446)..(446): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccggctactatatacacgtgggtgcgacacggcccctggacaaggctggagtgggagtgggatggactacgaaaccctaacaagtgggtaggacaacgaaactatcgacaacgaagtaagtttcgagggcagggtacacatcgacgaggacacgtccatcagcacagcctaacagtggacncgtagacgcgaggctaggagtatacgtacgaaccggacgaaccgggtccgttaggttaacttacgtcggtaggaccggaaggacggacgaagggtaaacgtttacggtaggtttttaggtaaggg

SEQ ID NO: 355946 - DNA, 607 bp, Homo sapiens
  misc_feature: GZ8MTXP02HN46G.45.78.H01.1.454.CMB.2.raw
  modified_base (456)..(456): a, c, t, g, unknown or other
  misc_feature (456)..(456): n is a, c, g, or t
  modified_base (590)..(590): a, c, t, g, unknown or other
  misc_feature (590)..(590): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagttgttagttcggacggttatggacgtgtggggccaaggggaccacggtcaccgtctcctcacgcctcccacccgaacggggcccctaacgtcccgggttccctttccccccgngggtacccctaccccctcccgttcccgaaacgtacgcccaacccgttccgtcgggggaccacgacggccgggcccgttgggggcctcggccgtcggtacgaaacggactacctttccgcgaacgtcgcgttcgngtcggccgggtctcggg

SEQ ID NO: 355947 - DNA, 646 bp, Homo sapiens
  misc_feature: GZ8MTXP02GYT4N.45.78.H01.1.454.CMB.2.raw
  modified_base (250)..(250): a, c, t, g, unknown or other
  misc_feature (250)..(250): n is a, c, g, or t
  modified_base (442)..(442): a, c, t, g, unknown or other
  misc_feature (442)..(442): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtccaggatccagtggggatgttgtgatgactcagtctccactctccctgcccgtcaccttggacagccgcctcatctcctgcaggtctagtacaaagcctacctaatacgagggataggaaacnctcacttagtaattggttacaaacgagaggccaggaccaaatcctacgaaaggcgtaccttaaatttaagtaaaggtttcgtaaaccgggacttcggtacggggtacccaagacaagtactcgaggcggaccgaaggttgggacaggcaacttgtatttcaacaactaagtaaaaattaggtagggtggagngtaggaggtagttggttaggttagtttatttgtgatagtagacgtaaaggtaacaacgtacgtacggtaccgtaacgtacgttttggaccggtaacggggaaccaaaggacgtaaggaaaactaacgaaaaacgtaaacgttaggtaggtactacgaccaacctaatcttcgttacttactacttcccttacccgaccctaacg

SEQ ID NO: 355948 - DNA, 497 bp, Homo sapiens
  misc_feature: GZ8MTXP02FID1V.45.78.H01.1.454.CMB.2.raw
  modified_base (417)..(417): a, c, t, g, unknown or other
  misc_feature (417)..(417): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggggcctcagtgaaggtctcctgcaaggcttctggatacaccttcaccggctactatatacactgggtgcgacaggcccctggacaagggcttgagtggatggggatggatcaacctaaccaatggtggcacaaactatgcacagaagtttcagggcagggtcacatgacagggacacgtccatcagacacagcctanactggagctgagcaggctgagatctgacgacacggccgtgtatactgtgcgaagaggcaggaattacgagttttggtagg

SEQ ID NO: 355949 - DNA, 516 bp, Homo sapiens
  misc_feature: GZ8MTXP02JGVZG.45.78.H01.1.454.CMB.2.raw
  modified_base (353)..(353): a, c, t, g, unknown or other
  misc_feature (353)..(353): n is a, c, g, or t
  modified_base (413)..(413): a, c, t, g, unknown or other
  misc_feature (413)..(413): n is a, c, g, or t
  modified_base (439)..(439): a, c, t, g, unknown or other
  misc_feature (439)..(439): n is a, c, g, or t
tcagacgcgatcgacacgaccggtgctcgatttagtgtgagtagtttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactggtgcgacaggcccctggacaagggcttgagtggatgggatggatcaacctaacaatggtgcacaaactntgcacagaagtttcagggcagggtcaccatgaccaggacacgtccatcagcacagcctanatggagctgacgcgagcgtgagatcnggacgacgacggtccgtagtaacgttcgtgtgacggaagacgggacgaggtaacttacggttacgttttaggtaagg

SEQ ID NO: 355950 - DNA, 559 bp, Homo sapiens
  misc_feature: GZ8MTXP02I4U0J.45.78.H01.1.454.CMB.2.raw
  modified_base (425)..(425): a, c, t, g, unknown or other
  misc_feature (425)..(425): n is a, c, g, or t
  modified_base (434)..(434): a, c, t, g, unknown or other
  misc_feature (434)..(434): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctggacaagggcttgagtggagtgggatggataccaaccctaacaagtggtagacaacaaactatgcaacagtaagttcgagggcagggtcacatcgacgaggacacgtccatcagcacagccctanagtaggacncgtagacgcgacggctaggagtatcgtacggaaccgacgaccgggtccggttagttaacgttacgtggtcggacggaaggacggacgtaacgggtaagtttacggtttaggtttttagggtaagg

SEQ ID NO: 355951 - DNA, 623 bp, Homo sapiens
  misc_feature: GZ8MTXP02G43D1.45.78.H01.1.454.CMB.2.raw
  modified_base (254)..(254): a, c, t, g, unknown or other
  misc_feature (254)..(254): n is a, c, g, or t
  modified_base (374)..(374): a, c, t, g, unknown or other
  misc_feature (374)..(374): n is a, c, g, or t
  modified_base (585)..(585): a, c, t, g, unknown or other
  misc_feature (585)..(585): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgcaaggcttnggatacaccttcaccggctactatatacacgtgggtcgcgacgacggcccctaggacgaagggtcttaggagtggagtgggatggatacaaacctaacaagtggtacgacaactaaactntcgcaacgtaggtaagtttcgaggggacacggggtacaaccgtagtacgaaaccggagggaacctacggtccaagtaccgaacggaccaacgtaacggacccttaaacgacggttacgggaacgtccgaggaacgtacgaacgggtcgtaggaacgtacgtacggacggaaccgaccggtaccgggtccgtaggttacttacgtgtcgagnggacgacggtagtaacgttagtttaggtttaggtaggg

SEQ ID NO: 355952 - DNA, 615 bp, Homo sapiens
  misc_feature: GZ8MTXP02JKWC0.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggttatgggtacgtcgtgggggccaaggggaccacggtcacccgtctaccctcacgccctcccgaccgaacgggcccactccgggtcccttcccccgtcggccctacccctcccttacccgaaacgacggaccctaacccgtcgtcgggggccacgacggcccgggccccgtcggggcctcggcccgtacgggtaccgtaaacgggtacctaaccgttcccgtacgaacgtccgtcgtcgtcgacggccgggtcgcggg

SEQ ID NO: 355953 - DNA, 586 bp, Homo sapiens
  misc_feature: GZ8MTXP02GC6WP.45.78.H01.1.454.CMB.2.raw
  modified_base (572)..(572): a, c, t, g, unknown or other
  misc_feature (572)..(572): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctagacgacacggccgtgtattactgtgcgaggaggcaggtaattacgtagtttttgggagttggttagttcggaacggttatcggggtacgtcggtagggggacccaagggggacccacgggtcacccgtctccctcacgccctccaccgacgggccctacgtccggttccttcccccgtggccaccctcctccaacgcgccacctcgtcggggcacgcgccggccctgggcctcgccgtcggtacgaaacggctaccgtccgtcgcgtccggcgttccggngacggcggcgtcgg

SEQ ID NO: 355954 - DNA, 609 bp, Homo sapiens
  misc_feature: GZ8MTXP02H0S02.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctagacgacacggccgtgtattactgtgcgagaggcaggaattacgtagtttttggagttggttattggacggttatgggtacgtcgtgggggcctaaggggaccacgggtccaccgtctccctcacgccctccaccgaacgggcccacgtaccggtccttcccccgtagccctaacccctccctaccacgacgccaccctcggtacgggggcaccgacgccggacccgtggggcctcggtcccgtcggtaccggaaacggtccttaccgttcccgttcgaacgttccggtccgttcgtacggcggtccgggcgtcgggg

SEQ ID NO: 355955 - DNA, 535 bp, Homo sapiens
  misc_feature: GZ8MTXP02F5MXH.45.78.H01.1.454.CMB.2.raw
  modified_base (359)..(359): a, c, t, g, unknown or other
  misc_feature (359)..(359): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaaggcttgagtggagtggggatggatacaacctaacaagtggtggacaacaaactntgacaacagtaagtttcgaagggcagggtcacatgacgaggacacgtcatcagacacacgctaacatggagcgtagacgcgaggctagagatcgaggacgacgacggccgtagtacttacgtaggtgacggaaggaggacgtaaggtaaagtttacggttaagttttagggtaagg

SEQ ID NO: 355956 - DNA, 646 bp, Homo sapiens
  misc_feature: GZ8MTXP02IPPZZ.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcaggtcaccatgaccagggacacgtccatcagcacagcctacatggagctgagcgaggctgagatctgacgacacggcgtgtattacgtgtgcgagaggcaggaattacgtagtttttggagttggttagttcgggtaacgttagtggggtacgtcggtcggggaccgaaaggggcctaacgggtcaacccgtctcccgtcacgccctcccgaacccgaaacgggcccctaacgttccgggtcccttcccccgtcggtccctaacccctcccttaccgaaacgaccgacctacccgtccgtacgggggaccaacgacggccggtcccgtcggggcctcggtccgttacggtaaccgaaacgggtacccttaaccgtttcccgtacggaacttccgcgttcgacggacggccgggtcgtacggg

SEQ ID NO: 355957 - DNA, 510 bp, Homo sapiens
  misc_feature: GZ8MTXP02JDJCL.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggccccctggacaagggcttgagtggatgggatggatcaacctacaatggtggcacaaactatgcacagaagtttcagggcagggtcacatgaccagggacacgtccatcagcacagcctacagtggagctgacgcgaggctaggagatcgtagacgacgacggccgtgtacttacgtgtgcgaagaggacgaggaattacggtaagttttggtaagg

SEQ ID NO: 355958 - DNA, 609 bp, Homo sapiens
  misc_feature: GZ8MTXP02GIZP2.45.78.H01.1.454.CMB.2.raw
  modified_base (379)..(379): a, c, t, g, unknown or other
  misc_feature (379)..(379): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggtcttctggatacaccttcaccggctactatatacactggtgcgacaggcccctggacaagggcttggagtgggatggggatggatcaacctaaccaatggtggacacaaactatgcaacagagtttcagggnagggtcacatgacagggacacgtcatcagacacacgccctaacagtaggagaccgtaggacgaccgaagggccgtaggaagtacgttacgtacggaccggaaacccggaccggggtacccgttaggttaaacgttaacccgttgggtacggaccggaagggaacgggtaccggtaaaaggggttaaaccgttttaacgggttaacggttttttacggggtttaaaggggg

SEQ ID NO: 355959 - DNA, 558 bp, Homo sapiens
  misc_feature: GZ8MTXP02I7PNS.45.78.H01.1.454.CMB.2.raw
  modified_base (287)..(287): a, c, t, g, unknown or other
  misc_feature (287)..(287): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtncgacaggcccctggacaagggcttgagtggatgggatggatcaacctacaatggtgacacaaactatgcacagtagttcagggcagggtcacatgacaggacacgtccatcagcacagacctacacgtaggagtacgagagccgaaggcgtagaggatccgagaaccggacgaaaccgggtccggttagttaacgtttaccgtacggttaggaccggtaaggaggggaccgtaaacggggtaatttaacggtaagtttttaggggtaaggg

SEQ ID NO: 355960 - DNA, 591 bp, Homo sapiens
  misc_feature: GZ8MTXP02J11W9.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtatactgtgcgagaggcaggtaattacgtatttttggagtggttattcggacggttatgggacgtcgtggggcaagggcacggtcaccgtctcctcacgccctccaccgacggcccacgtccggtccttcccccgtcgggccaccccgtccctccaacgacggacctacctccgtcgggggccacgacggcccggcccgtcggggcctcggcccgtcgggtaccgaaacgggcctaaccgttccctacggcgtcggtccgtcgttcggcggccggggtcgtcgggg

SEQ ID NO: 355961 - DNA, 584 bp, Homo sapiens
  misc_feature: GZ8MTXP02I0AJB.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtatactgtgcgagaggcaggaattacgtatttttggagttggttattcggacggttatgggacgtcgtgggggccaaggggacacgggtccaccgtctcctcacgcctcccaccgaacgggcccactccggtccttccccctggccaccctcctccaacgacgcaccctcgtgggggcacgacgccgcccgtcggggctcggcctcgggtaccgaacggtacctacctttcccgtacgtaacgtccggtcgtccgtaggacggcggggccgtacgggg

SEQ ID NO: 355962 - DNA, 735 bp, Homo sapiens
  misc_feature: GZ8MTXP02HFKVT.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctagacgacacggccgtgtattactgtgcgagaggacgagaattacgtagtttttggagttggttaagttcggaacggttatcggggtaacggttcggtgggggaccgtaaacggggacccgtaaccggggtcccgtaacccggttccgtcccttaccgaccggtcccttaccccgaacccgaaaccgggggtcccccaacgttcccgggttcccctttaccccccgttgggacccctaaccccctccccgttacccaaaccggtaccgaccgtaccccgtcgggtcgggggacccaaacggaccggcccgggcccgttcggggcccgttcgggcccggttacgggttaccggaaaacggggtaacccttaccggtttccctaacccgggtaacttacccgggtccgttacgttacgggtaccggacccgggggtcttaaccggggg

SEQ ID NO: 355963 - DNA, 583 bp, Homo sapiens
  misc_feature: GZ8MTXP02J0H1M.45.78.H01.1.454.CMB.2.raw
tcagacgcgatcgacacgaccggtgctcgatttagtgtgagtagtttgggtttgggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggctggtatcagcagaaaccagggaaacgcccctaagctcctgctctataaggcatctagttagaagtgggtccatcaagtcagcggcagtgatcgtggacagattcactctcaccatcagcagcctgcagccctgatgtattttgactaactttattacgttacgaccaaactagttatagtaattaggtttaacttccggtaaccgtttccgggaccgtaaaacgggggtaacccgtaaaaggggtaacggaaaacttaaccggaaaaacgtaacggttaggtacggtccgtacggccgtaaccctaattccgttcgttacctttctactttccccg

SEQ ID NO: 355964 - DNA, 507 bp, Homo sapiens
  misc_feature: GZ8MTXP02GKC54.45.78.H01.1.454.CMB.2.raw
  modified_base (288)..(288): a, c, t, g, unknown or other
  misc_feature (288)..(288): n is a, c, g, or t
  modified_base (422)..(422): a, c, t, g, unknown or other
  misc_feature (422)..(422): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggggcctcagtgaaggtctcctgcaaggcttctggatacaccttcaccggctactatatacactgggtncgacaggcccctggacaagggcttgagtggatgggatggatcaacctaacaatggtggcacaaactatgcacagaagtttcagggcagggtcacatgacagggacacgtccatcagcacagcctacacgtggancgtgaacgcaggctgagatctgacgacgacggccgtggtacttacgtgtcgcgaagaggcgaggattacgtagttttaggtaagg

SEQ ID NO: 355965 - DNA, 597 bp, Homo sapiens
  misc_feature: GZ8MTXP02HKRV0.45.78.H01.1.454.CMB.2.raw
  modified_base (197)..(197): a, c, t, g, unknown or other
  misc_feature (197)..(197): n is a, c, g, or t
  modified_base (273)..(273): a, c, t, g, unknown or other
  misc_feature (273)..(273): n is a, c, g, or t
  modified_base (350)..(350): a, c, t, g, unknown or other
  misc_feature (350)..(350): n is a, c, g, or t
  modified_base (417)..(417): a, c, t, g, unknown or other
  misc_feature (417)..(417): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccggcagtcagagtattagtaactggttggcctggtatcagcagaaaccaggaaacncccctaagctcctgctctataggcatctagttagaaagtgggtccatcaagtcagccggcagtgatcgtagggaaanattcactctcaccatcagcagccctgcagcctgatgtattttgactaactttatactgaccctaaanagttatatagttagttagttacgtacggttaccgggaccgtaaaaggggaacccgtaaaagggtaacggtaaaacttaaaccgaaaaaccggtaacgttaggtaacggtccgttacggaaccgtaacccgttaaacttccgtttaaccggtttcctttaaccgttaaccgttttcccccg

SEQ ID NO: 355966 - DNA, 595 bp, Homo sapiens
  misc_feature: GZ8MTXP02HA393.45.78.H01.1.454.CMB.2.raw
  modified_base (250)..(250): a, c, t, g, unknown or other
  misc_feature (250)..(250): n is a, c, g, or t
  modified_base (551)..(551): a, c, t, g, unknown or other
  misc_feature (551)..(551): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctgagtgaaggtctctgcaggcttcnggatacaccttcaccggctactatatacacgtggtgcgacacggccctggacaaggcttgagtggagtgggatggactaccaacctaacgagtggtacggacaacgaaacttagtcgaccaacgtaaggtaagtttaccgaaggggtacgtaaggggtaccaaccgagtacgaaccgagggaccacggtaccagtacgaacgacaacgaacgtccctaagagtacgggaacgcgtaggaacggccgacggtacgtacggacgtacgtcgaacggacgacgacggtccgtagtacgttacgnggtcgaggaagaggacgaggtaacgttacgtagttttacggagg

SEQ ID NO: 355967 - DNA, 565 bp, Homo sapiens
  misc_feature: GZ8MTXP02JDM6X.45.78.H01.1.454.CMB.2.raw
  modified_base (373)..(373): a, c, t, g, unknown or other
  misc_feature (373)..(373): n is a, c, g, or t
  modified_base (454)..(454): a, c, t, g, unknown or other
  misc_feature (454)..(454): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaggtcttcgtggatacaccttcaccggactactatatacacgtgggtgcgacgcggcccgtggacaagggctggagtggagtggggtatggatacctaaacccctaaataagtcggggtagaccaacaaatntgacaacgaagtaacgtttcgagggcagggtacacgatacgaacgagggaccacgtccatacgacgacacgacgacctaanacggtggacgcgtaggacgcgaggcgtagaggatcgagaacgccgacggccgtagtacgttacgtggtcgacggaaggaggacgaggtaattacggttagtttaggtaagg

SEQ ID NO: 355968 - DNA, 573 bp, Homo sapiens
  misc_feature: GZ8MTXP02H8H38.45.78.H01.1.454.CMB.2.raw
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctctatacagggatggaaacactcacttgaattggttcaacagaggccaggccaatctcaaggcacctaatttataaggtttcaacgggctcgtggggtcccagacagattcagcgcaggtggtcaggcactgatttcacactagaaaattggaggtggagtcgtaggaggtagtggttggttagttttatttcgtgctagtagactaaggtacactacgtggaccgtactacgtttcggaccgtaggggacctaaggcgtaaggaaactacgaaaacgtacgtagtacgggctcgaccaaccgtacttcgtacgttccttacacttcccgttacccgtacctacg

SEQ ID NO: 355969 - DNA, 532 bp, Homo sapiens
  misc_feature: GZ8MTXP02G5MUP.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaaggcttctggatacaccttcaccggctactatatacacgtggtgcgacaggcccctggacaaggcttggagtggatgggatggatccaaacctaacaatggtagacacgaaactatgcacagaagttcagggcagggtacacgagtagaccgaggacacgtccgatcagacacacgacctacagtaggagcgtagagcgaaggctaggagtacgtcgtacgacgacgaaccggcgtagtacttacgtgtgacgaagaggacgaggtattacggtagtttaggtaagg

SEQ ID NO: 355970 - DNA, 624 bp, Homo sapiens
  misc_feature: GZ8MTXP02I0AK0.45.78.H01.1.454.CMB.2.raw
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagcccggcctccatctcctgcaggtctagtcaaagcctcctatacagggatggaaacactcacttgaattggttacaacagaggccaggccaaatctaccgaaggcgtacctaaattttataaggtttcctaaaccgggtctcgtcggggtacccagacagtattcaggcgcaggtggtcaggcactgtatttcaactacgtagtaaaagttaggtaggggtggaggctggaggtattggtttagtacgtttttatttcgtggtacagtgacgtaaaggttacaacgtacgttcgggtaccgttaacgtacgttttcgggacccgtaagggggaaccctaaggtacgtaaggtaaaacttacgaaaacgtaacgtcggtacggcttacgacctacgtatcgttcgttacttcactttccttcccgacttacg

SEQ ID NO: 355971 - DNA, 624 bp, Homo sapiens
  misc_feature: GZ8MTXP02H97AX.45.78.H01.1.454.CMB.2.raw
  modified_base (441)..(441): a, c, t, g, unknown or other
  misc_feature (441)..(441): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagtttcagggcagggtcaccatgaccagggacacgtccatcagcacagcctacatggagctgagcaggccgagatctgaccgacacggccgtgtattactgtgcgagagcagattacgattttggagtggttattcgggacgtatggcgtcgtggggcctaagggaccacggtcaccgtccgtcctcacgccctccaccgaacgggcccacgtccggtcctttcccccgnggtcccaccccgttcctaccctaacgacgccaacccgttcgacgggggccacgacggcccggccccgttcgggggcccttcggcccgttcgggggtaccaaaacggggtaccttaaacccgtttcccgttcggaacttccggcccgttccgttggaacgggccggggtcgttcgggaacccgg

SEQ ID NO: 355972 - DNA, 540 bp, Homo sapiens
  misc_feature: GZ8MTXP02HRJ05.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttggagtggatgggatggatcgaaacctaaccaagtggtggcaacaaactatgacaacaagaagtttcagggcagggtcaaccatagaccagggacacgtacccatacagcacagcctacagtggagctgagcgaggcgtgaagacgtacagacgacgacggccgtaggtacttacgtcgttacgcgaaggacggacgacgggtaatttacggtagtttttaggtaacggg

SEQ ID NO: 355973 - DNA, 550 bp, Homo sapiens
  misc_feature: GZ8MTXP02I96EA.45.78.H01.1.454.CMB.2.raw
  modified_base (250)..(250): a, c, t, g, unknown or other
  misc_feature (250)..(250): n is a, c, g, or t
  modified_base (341)..(341): a, c, t, g, unknown or other
  misc_feature (341)..(341): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtgggcctcagtgaaggtctcctgcaaggcttcnggatacaccttcaccggctactatatacacgtgggtgcgacaggcccctggacagggcttggagtggatgggatggataccgaaacctaanaagtggtcgacaacaaactatgacaacagtaacgtttcgaaggggcgagggtacaacccatcggaaccgacgggaacacgtcccagtacagacacagacctaacagtggacgacgtgaacgcgaggctgagatcaggacgacgacggcgtagttacgttacgagtcgagaaggaggacgacggtaagtttacggtagttttaggtaagg

SEQ ID NO: 355974 - DNA, 599 bp, Homo sapiens
  misc_feature: GZ8MTXP02IORNA.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgtatttttggagttggttagttcggacggttatgggacgtcgtggggccgaagggacgacggtcaccgtctcctcacgccctccaccaacgggcccacgtcggtcccttccccgtcggccctaccctcctccgaacgacgcccaccgtcgtcgggggacaaccgacggcccggcccgtcggggtccgtcggtccgtcggtaccgaaacgggtaccttaccgttccgtccgtaagtccggcgtcgtcggacggcggggtccgtcgggg

SEQ ID NO: 355975 - DNA, 573 bp, Homo sapiens
  misc_feature: GZ8MTXP02HWD0G.45.78.H01.1.454.CMB.2.raw
  modified_base (312)..(312): a, c, t, g, unknown or other
  misc_feature (312)..(312): n is a, c, g, or t
  modified_base (466)..(466): a, c, t, g, unknown or other
  misc_feature (466)..(466): n is a, c, g, or t
  modified_base (569)..(569): a, c, t, g, unknown or other
  misc_feature (569)..(569): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattacngtgcgagaggcaggaattacgatttttggagtggttattcggtacgtagtgggacgtgtggggccgtaagggccacggtcaccgtctcccgtcacgccctaccacgaacggcccacgtccggtcctccccgtgccctaccctccgtacacgacncctaccgtcggcggggaccacgacggcccggtccgtcggggccttcgccgtcgtacgaacggtactaccttccgacgtaacgtcgcgttcgcgcggtcggtcncggg

SEQ ID NO: 355976 - DNA, 517 bp, Homo sapiens
  misc_feature: GZ8MTXP02FQCWN.45.78.H01.1.454.CMB.2.raw
  modified_base (271)..(271): a, c, t, g, unknown or other
  misc_feature (271)..(271): n is a, c, g, or t
  modified_base (348)..(348): a, c, t, g, unknown or other
  misc_feature (348)..(348): n is a, c, g, or t
  modified_base (379)..(379): a, c, t, g, unknown or other
  misc_feature (379)..(379): n is a, c, g, or t
  modified_base (409)..(409): a, c, t, g, unknown or other
  misc_feature (409)..(409): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggtggcctggtatcagcagaacaggaaancccctaagctctgctctataaggcatctagttagaaagtcgggtccatcaaggttcagcgcagtggatcgtgggacngaattcactctcacatcagcagcctgcagcngatgtatttgctaaacttatactgaccaanagtatgattagttattcgacgttcgacgtaaagggaccaaggtaggaaactacgaaaacgtaacctggtacgtacgtaagaccaacgtactctacgtccttactaacg

SEQ ID NO: 355977 - DNA, 547 bp, Homo sapiens
  misc_feature: GZ8MTXP02IVIQX.45.78.H01.1.454.CMB.2.raw
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggccccctggacaaggggctggagtggatgggatggatacaaaccctaacaagtggtggaccaacaaactatagacaacgagtaggtttcgaggggacgagggtccacatcgacgagggacacgtcatcagcacagcctacatcggagcgtgacgacggacggtcgacgaagcgtacgaggaccgacgacgggctaggtacttacgtgtagacgacgacgagaaggaagttaagtagtttggagtcggttagtcggtaagg

SEQ ID NO: 355978 - DNA, 569 bp, Homo sapiens
  misc_feature: GZ8MTXP02G2ZRF.45.78.H01.1.454.CMB.2.raw
  modified_base (442)..(442): a, c, t, g, unknown or other
  misc_feature (442)..(442): n is a, c, g, or t
  modified_base (451)..(451): a, c, t, g, unknown or other
  misc_feature (451)..(451): n is a, c, g, or t
  modified_base (472)..(472): a, c, t, g, unknown or other
  misc_feature (472)..(472): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggcttctggatacaccttcaccggctactatatacacgtgggtgcgacacggcccctggacgaagggcttggagtggatgggatgataccaacctaacagtggtgacaacaaactatcgacaacgagtaagttcgaaggggcaacggggtcacgagtacgaaccgaggacacgtccaatcaagccacacgccctanacgtgggancgtagacgcgagggctagganagtcgacggacgacgacggtaccgttgtaacttacgtggtcggacggaagggacggtacgtaaaggtaagtttacggttaagtttttgggtaaaggg

SEQ ID NO: 355979 - DNA, 580 bp, Homo sapiens
  misc_feature: GZ8MTXP02I6FS3.45.78.H01.1.454.CMB.2.raw
  modified_base (444)..(444): a, c, t, g, unknown or other
  misc_feature (444)..(444): n is a, c, g, or t
  modified_base (489)..(489): a, c, t, g, unknown or other
  misc_feature (489)..(489): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggttatgggtacgtcgtggggcctaaggggaccacggtcaccgtctacctcacgccctccacgaacggcccactccggtccttccccnggcccaccctccctccaacgacgccacccgtcgtcggggcaacgngccggccgtgggctcgaccgtcggtacgaacgggtacttaccgttccgttcgaacgttccggtcgttccgtacggcggccgggtcgtcggg

SEQ ID NO: 355980 - DNA, 689 bp, Homo sapiens
  misc_feature: GZ8MTXP02FVW51.45.78.H01.1.454.CMB.2.raw
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcgtggatacaccttcaccggctactatatacactgggtgcgacgacggcccctggacgaagggcttggagtggagtgggatgggactaccgaaaccctaaacaagtggtaggaccaacgaaactatgacacaagtagtttcgagggacgaggggtacacgagtcgaccgagggacacgtacatcagcacacgcctacgagtggagcgtcggagacgaagggtctaggagtacgttacgtacggaacggaaccgtaccggggtacccggttaggtttaaacgtttaaccgggttgggttaccgggacgggtaaacggggtaacggggaaccggtaaaacgggggtttaaaacggttttaaacgggtttaaacggtttttttttacgggggtaaacgggtttttacgggggttttaaaacgggttttaccgggggtttaaaaccggggg

SEQ ID NO: 355981 - DNA, 520 bp, Homo sapiens
  misc_feature: GZ8MTXP02GU1JR.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaaggcttgagtggatgggatggatcaacctaacaatggtggcaacaaactatgcacagaagtttcagggcagggtcaccatgacgagggacacgtccatcagcacagcctaacagtaggagctgagcgaggcgtagagatcgagacgacgacggccgttagtacttacgtgtgacggaagacggacgtaaggtaattacggtagtttttaggtaagg

SEQ ID NO: 355982 - DNA, 616 bp, Homo sapiens
  misc_feature: GZ8MTXP02ICMT8.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagtttcagggcagggtcaccatgaccagggacacgtcatcagcacagcctacatggagctgagcgaggctgagatctgacgacgacggcgtgtattactgtgcgagaggacgaggtaattacgtagtttttggagttggttagttcggtacggtattcgggtacgttcgtcgggggaccgaacgggaccgacggtctacccgtcctccctcacgccctcccaccgaacgggcccacgtccgtcccttcccccgcggtacccctaccctccctaccaacggaccgaccgaccgttcggacgggggccaacgcggcccggccccggtgggccgtcgccggtcgtacgaaacggtaccctacgttcccgtcgtaacgtcgccgttcgcggacggcgggtacgtcggg

SEQ ID NO: 355983 - DNA, 552 bp, Homo sapiens
  misc_feature: GZ8MTXP02H57N1.45.78.H01.1.454.CMB.2.raw
  modified_base (289)..(289): a, c, t, g, unknown or other
  misc_feature (289)..(289): n is a, c, g, or t
  modified_base (483)..(483): a, c, t, g, unknown or other
  misc_feature (483)..(483): n is a, c, g, or t
tcagacgcgatcgacacgaccggtgctcgatttagtgtgagtagtttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtctggggctgaggtgaagaagccgtgggcctcgagtgaaggtctcctgcaaggcttctggatacaccttcaccggctactatatacactggtgngacaggcccctggacaaggctgagtgatggatggatacaacctaaccaatggtggacaacgaaaacttatgacaacagaagtttacgaaggggcagggtccaaccaagtagaaccgaaggggaccaacggttaccaactacgaacggccaacacggaccctaagagtaggaagccgtagagcgaggcagacganacgacgacgacgacgcgtacgtacgtacgtcgtagagaagagacgtagtaagttacgttagtttagtag

SEQ ID NO: 355984 - DNA, 550 bp, Homo sapiens
  misc_feature: GZ8MTXP02JKYCZ.45.78.H01.1.454.CMB.2.raw
  modified_base (254)..(254): a, c, t, g, unknown or other
  misc_feature (254)..(254): n is a, c, g, or t
  modified_base (350)..(350): a, c, t, g, unknown or other
  misc_feature (350)..(350): n is a, c, g, or t
  modified_base (370)..(370): a, c, t, g, unknown or other
  misc_feature (370)..(370): n is a, c, g, or t
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcgagtgaaggtctcctgcaaggcttcgnggataccgaccttcaccggctactatatacacgtgggtgcgacacggcccctaggacaaggtcttgaggtggagtgggatggatccaaaccctaanagtggtcgacaacgaaactntcgacaacaggtaaagtttcgaaggggcacgggtacaccgatacgaccgaggacacgtccatacgagcacgagccctagaagtcggatcgagaacgcgaaggcgtagaggactcgaggacgacgacggcgtagtagttacgcgcgagaagacgacgtacgtagtacgttacgttaggtag

SEQ ID NO: 355985 - DNA, 514 bp, Homo sapiens
  misc_feature: GZ8MTXP02G7GJJ.45.78.H01.1.454.CMB.2.raw
  modified_base (414)..(414): a, c, t, g, unknown or other
  misc_feature (414)..(414): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctggacaagggcttgagtggatgggatggatcaacctacaatggtagacacaaactatgacacagagtttcgagggcagggtcacatgacgaggacacgccatcagcacagcctanagtgagcgtagacgcgaggctagagatcagacgacgacggccgtgtacgttcgtagtcgacgaagaggactaggtaacgttacgttagtttaggtaaggg

SEQ ID NO: 355986 - DNA, 576 bp, Homo sapiens
  misc_feature: GZ8MTXP02I167U.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgaggatctgacgacacggccgtgtattactgtgcgagaggcaggaattacgatttttggagtggttattcggacggttatgggacgtcgtgggggccaaggggaccacgggtcaccgtctcctcacgcctccaccacgggcccagtccggtcctccccctggcccacccgtccctaccaacgacgccacccgtcgtcgggggcacgacgcggcccgtgggcctcggcctcgggtacaacgggtacctaccgttccctcgaacgtccgcgttcgtggacggccgggtcgtcggg

SEQ ID NO: 355987 - DNA, 530 bp, Homo sapiens
  misc_feature: GZ8MTXP02HVA5T.45.78.H01.1.454.CMB.2.raw
  modified_base (353)..(353): a, c, t, g, unknown or other
  misc_feature (353)..(353): n is a, c, g, or t
tcagacgcgatcgacacgaccggtgctcgatttagtgtgagtagtttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcacggctactatatacactgggtgcgacaggcccctggacaaggctgagtggatgggatggatcaacctaacagtggtggacacaaactntgcaacagtaagtttcaggggcaggggtcaccgatacgaccgaagggaccacggtaccatacacgcacagccctaacatagggagcgtgagcgaaggtcgagagatcgacgacgacgacggccgtagtacttacgtgtacgcgaagaggacgacggtattacgtagttttaggtagg

SEQ ID NO: 355988 - DNA, 567 bp, Homo sapiens
  misc_feature: GZ8MTXP02IQ5K1.45.78.H01.1.454.CMB.2.raw
  modified_base (249)..(249): a, c, t, g, unknown or other
  misc_feature (249)..(249): n is a, c, g, or t
  modified_base (348)..(348): a, c, t, g, unknown or other
  misc_feature (348)..(348): n is a, c, g, or t
  modified_base (370)..(370): a, c, t, g, unknown or other
  misc_feature (370)..(370): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctcagtgaggtctctgcaggcttcnggatacaccttcaccgctactatatacacgtgggtgcgacaggccccctggacgaagggtcttggaggtgggatggggatggactaccaaacccgtaanaagtgggtacgacaacaaactntgacaacgaagtacgtttcgagggcagggtcacagtacgaaccgagggacacgtccaatcgaagcacgagaccctaacgagttagggacgtacgtaggagaccgaagggctaggagtactcgtagacgacgacggccgttagtacttacgtgtacggagaaggaggacgtaggtaagtttacgtagttttaggtagg

SEQ ID NO: 355989 - DNA, 534 bp, Homo sapiens
  misc_feature: GZ8MTXP02IH89U.45.78.H01.1.454.CMB.2.raw
  modified_base (250)..(250): a, c, t, g, unknown or other
  misc_feature (250)..(250): n is a, c, g, or t
  modified_base (454)..(454): a, c, t, g, unknown or other
  misc_feature (454)..(454): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagcctgggcctcagtgaaggtctctgcaaggcttcnggatacaccttcaccggctactatatacactgggtgcgacaggcccctggacaaggcttgagtggatgggatggatacaacctaacaagtggtagacaactaaactatcgacaacagtaagtttcgagggacagggtacacatcgacgaggacacgtccatcagacacacgacctacagtaggagcgtagagcgaggcgtgagntcgtacgacgacgacggcgtagtacttacgtcgtagacgtaaggacgacgtaggtaagttacgttagttttacggtaagg

SEQ ID NO: 355990 - DNA, 632 bp, Homo sapiens
  misc_feature: GZ8MTXP02F1NXS.45.78.H01.1.454.CMB.2.raw
  modified_base (225)..(225): a, c, t, g, unknown or other
  misc_feature (225)..(225): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctnagtgaaggtctcctgcaaggcttctggatacaccttcaccggctactatatacacgtgggtgcgacacggcccctggacaagggcttggagtggagtgggatggataccaaacctaacaagtggtagacaacaaactatcgacaacgaaaggtaacgtttcgaaggggacgtaggggtaccaaccgaagtacggaacccgaagggggaaccaccggttaccaactaccgaacggaccaaacgaacggacccttaacgaacggttacggacgacgtaggaacgacggaacggtcgtaggaagtaacgtcgtacggaacggacgtaccgggtcgttacgttacgttacgttggacggacggaaggaggacgtaaacgggtaatttacggtaaggtttttagggtaaggg

SEQ ID NO: 355991 - DNA, 594 bp, Homo sapiens
  misc_feature: GZ8MTXP02JG7X8.45.78.H01.1.454.CMB.2.raw
  modified_base (565)..(565): a, c, t, g, unknown or other
  misc_feature (565)..(565): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatcgtgacgacacggccgtgtattacgtgtgcgagaggcgaggtaattacgtagtttttgggagttggtttagttcggtagttgggtagtgggtacgtcggttgggggaccgaaggggacccgacgggtccaccgtcctccctcgacgccctacccaccgaacgggccctacgtccggttcctcccccgtcgcctacccctcctaccacgacgccaccgtcgcggggcacgacgccgccgtcggcctcgccgtcggtacgacggtacctaccgttccncgtacgtccgtcgtcgtcggacggcggcg

SEQ ID NO: 355992 - DNA, 523 bp, Homo sapiens
  misc_feature: GZ8MTXP02HEYNE.45.78.H01.1.454.CMB.2.raw
  modified_base (363)..(363): a, c, t, g, unknown or other
  misc_feature (363)..(363): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggcttctggatacaccttcaccggctactatatacacgtgggtgcgacaggcccctggacaagggcttggagtggagtgggatggatacaacctaacaagtggtagacacaaactangcacagtagttcgaggcgaggtcacatagacgaggacacgtcatcagacacagacctacgagtggagcgtgagcgaggcgtagagatcgtagacgacgacggtccgtagtacttacgtgtgacgaaggtacggacgaggtaattacgtagttttggtagg

SEQ ID NO: 355993 - DNA, 663 bp, Homo sapiens
  misc_feature: GZ8MTXP02GY1PL.45.78.H01.1.454.CMB.2.raw
  modified_base (296)..(296): a, c, t, g, unknown or other
  misc_feature (296)..(296): n is a, c, g, or t
  modified_base (301)..(301): a, c, t, g, unknown or other
  misc_feature (301)..(301): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctccgtgcaaggcttctggactacacccttcaccggtctactatatacacgtgggtncgacncggccccgtaggacgaaggcttaggagtggagtgggatggataccaacctaacagtggtaggacaactaaactagtcgacctaaacgaaggtaaacgtttcggaagggggtaccaacgggggttacccaaacccgtaacgtaccgggaaacccggaacgggggaaccctaaccggtaacccctaagtacccgaaacggaccaaaccgaacggtaacccttaaccgaggttacgggaacgcgttaggaacgcgaacgggtactaggagtacgtacgtacggaacgaccgcggttacggtgttaacgttcgtggtcgacggaagggacgacggtaaggtagttacgtttaggttttaggtaggg

SEQ ID NO: 355994 - DNA, 534 bp, Homo sapiens
  misc_feature: GZ8MTXP02FF3UD.45.78.H01.1.454.CMB.2.raw
  modified_base (397)..(397): a, c, t, g, unknown or other
  misc_feature (397)..(397): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggtatggacgtctggggccaaggggaccacgggtcacccgtntccctcagcctccaccaagggcccatcggtcttccccctggccacctccctccaacgagcacctctgggggcacgagcggccctgggctgccctggtcaacggactactcctcgaatcgcgtctcgagcgggctggg

SEQ ID NO: 355995 - DNA, 560 bp, Homo sapiens
  misc_feature: GZ8MTXP02G57WD.45.78.H01.1.454.CMB.2.raw
  modified_base (254)..(254): a, c, t, g, unknown or other
  misc_feature (254)..(254): n is a, c, g, or t
  modified_base (537)..(537): a, c, t, g, unknown or other
  misc_feature (537)..(537): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcgagtgaaggtctcctgcaaggcttcnggatacaccttcgaccggctactatatacacgtgggtgcgacacggcccctaggaacgaaggcttggagtggagtgggatggatccaaacctaacaagtggtgacaacgaaactagtgacacgaagtaagtttccgaggggacacggggtacaacgagtacggaaccgaggggaacaccggtaccaacgtaccaagacaacacggaccctaacgagttggagcgtaggacgacggacgcgagacgacgtacgagacgacgacggcgtagtactcgagtcgagngagacaggatacgtagtttagag

SEQ ID NO: 355996 - DNA, 744 bp, Homo sapiens
  misc_feature: GZ8MTXP02HO0SO.45.78.H01.1.454.CMB.2.raw
  modified_base (251)..(251): a, c, t, g, unknown or other
  misc_feature (251)..(251): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctctaatacgagggataggaaacnctcacttgaattggttacaaacagaggccaggccaatctaccaaggccacctaaattttataaaggtttcctaaaaccgggacttccgtcggggtaccccaagacctaagtactttacgaggtccggcccgtaaggtggggtcgaaacggggctaaaccttgggtactttttaccaactaaaccgttaagtaaaaaagttttggtaaagggggttagggaaacgggtgtaggtaaggtaagttggtttagggttaagtttttaacgtttcgttgggtactaagttgaacgttaaacgggtaactacgttaaacggttcggtacccgttaaacgttacggtttttacggaccgttaacgggggaaccctaaaggtccgttaaaggggaaaacttaacgaaaaacccggttaaaaggttcggtacgggtacttacggactaacccgtaagttccgttaagttctttacctactttccggtccccgtaactttacg

SEQ ID NO: 355997 - DNA, 509 bp, Homo sapiens
  misc_feature: GZ8MTXP02IHYAU.45.78.H01.1.454.CMB.2.raw
  modified_base (397)..(397): a, c, t, g, unknown or other
  misc_feature (397)..(397): n is a, c, g, or t
  modified_base (406)..(406): a, c, t, g, unknown or other
  misc_feature (406)..(406): n is a, c, g, or t
  modified_base (434)..(434): a, c, t, g, unknown or other
  misc_feature (434)..(434): n is a, c, g, or t
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (455)..(455): a, c, t, g, unknown or other
  misc_feature (455)..(455): n is a, c, g, or t
  modified_base (500)..(500): a, c, t, g, unknown or other
  misc_feature (500)..(500): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagagtctgacgacacggccgtgtattactgtgcgagaggcaggaattacgatttttggagtggttattggacggtatgggactcgtgggggccaaggggccacggtcaccgtcncctcagccncacacggccatcgctccctgccacctcnccancgcactcnggggcacgngcgcctcggctcgcctgcaacggctacttctcgaactcgcgtcgngcgcgcgcg

SEQ ID NO: 355998 - DNA, 527 bp, Homo sapiens
  misc_feature: GZ8MTXP02J3LCO.45.78.H01.1.454.CMB.2.raw
  modified_base (351)..(351): a, c, t, g, unknown or other
  misc_feature (351)..(351): n is a, c, g, or t
  modified_base (362)..(362): a, c, t, g, unknown or other
  misc_feature (362)..(362): n is a, c, g, or t
  modified_base (442)..(442): a, c, t, g, unknown or other
  misc_feature (442)..(442): n is a, c, g, or t
  modified_base (460)..(460): a, c, t, g, unknown or other
  misc_feature (460)..(460): n is a, c, g, or t
  modified_base (465)..(465): a, c, t, g, unknown or other
  misc_feature (465)..(465): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcgagtgaaggtctcctgcaaggtcttctggatacaccttcaccggctactatatacactgggtgcgacacggcccctggacaagggcttggagtggatggggatggatcgaacctaacaagttggngacacaaactntgcaacagaagtttcgagggacagggtcaaccgatcgacccgagggacacgtccaagtcaagcacacgcctacagtggancgtgagcgaggctagagntacgngacgacgacggtcgtgtactcgtcgagacgaaggacgacgagtaacttacgtagtttggtag

SEQ ID NO: 355999 - DNA, 516 bp, Homo sapiens
  misc_feature: GZ8MTXP02HPQXK.45.78.H01.1.454.CMB.2.raw
  modified_base (448)..(448): a, c, t, g, unknown or other
  misc_feature (448)..(448): n is a, c, g, or t
  modified_base (498)..(498): a, c, t, g, unknown or other
  misc_feature (498)..(498): n is a, c, g, or t
  modified_base (500)..(516): a, c, t, g, unknown or other
  misc_feature (500)..(516): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccggctactatatacactgggtgcgacacggcccctggacgaagggcttggaggtggagtgggatgggataccgaaaccctaaccaagtgggtacggacaacaaaactatcgacaacagtaaacgtttcgaggggcaggggtccacgagtgaaccgaggacacgtccatcagcacacgcctanagtaggagcgtggacggcgggcgtagggacgaacgggcgacgtagtaggngnnnnnnnnnnnnnnnnn

SEQ ID NO: 356000 - DNA, 511 bp, Homo sapiens
  misc_feature: GZ8MTXP02H6TYF.45.78.H01.1.454.CMB.2.raw
  modified_base (253)..(253): a, c, t, g, unknown or other
  misc_feature (253)..(253): n is a, c, g, or t
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
tcagacgcgatcgacacgaccggtgctcgatttagtgtgagtagtttgggtttgggggagcatcaccccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctctgcaggcttcnggatacaccttcaccggctactatatacactgggtgcgacaggccccctggacgaagggcttggagtggatgggatggatcaacctaacaatggtggcaacaaactatgacaacagtaagtttcgaggggcagggtcaccatacgacgaggacacgtcatcagcacagctacagtgagctagagcgaggctgagatcgtgacgacgcggccgtgtactacgngtgcggaagngacaggtattacgtagtttaggtagg

SEQ ID NO: 356001 - DNA, 700 bp, Homo sapiens
  misc_feature: GZ8MTXP02HBMP0.45.78.H01.1.454.CMB.2.raw
  modified_base (316)..(316): a, c, t, g, unknown or other
  misc_feature (316)..(316): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctagacgacacggtccgtgtattacgngtgacggagaggacgaggtaaatttacggtatttttgggagttaggtttagttacgggtacggttagtggggtaaccggttcggttcgggggacccgaaacgggggtacccgaccggggttacccaacccggttccgtcccttaccgaccggcccctaccccgaacccgaaaccggggcccctaaccgttcccggggttcccttccccccgttacgggcccctaacccccgttccctacccgaacgaaccggccaacccgttccggtcgggggccaaccgaccggcccgggcccgtcggggtccttcggcccgttcgggtacaacgggtacctaccgtttcccgttacgccgtcgtccggtcgttcgcgggcggtacgtcgggg

SEQ ID NO: 356002 - DNA, 512 bp, Homo sapiens
  misc_feature: GZ8MTXP02IRL6S.45.78.H01.1.454.CMB.2.raw
  modified_base (338)..(338): a, c, t, g, unknown or other
  misc_feature (338)..(338): n is a, c, g, or t
  modified_base (358)..(358): a, c, t, g, unknown or other
  misc_feature (358)..(358): n is a, c, g, or t
  modified_base (425)..(425): a, c, t, g, unknown or other
  misc_feature (425)..(425): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaggtctcctgcaggctctggatacacctcaccgctactatatacactgggtgcgacacggcccctggacaagggcttggagtggagtgggatggatacgaaccctaanaacgtggtgacaacaaactntgcacagtaagttcgagggcagggtcacatgacgagggacacgtccatcagcacagcctacatggancgtcgagcgaggcgtagagatcgagacgcgacggcgttagtacttacgtgtgagaaggaggacgtaaggattaggtagtttggtagg

SEQ ID NO: 356003 - DNA, 742 bp, Homo sapiens
  misc_feature: GZ8MTXP02I19GL.45.78.H01.1.454.CMB.2.raw
  modified_base (271)..(271): a, c, t, g, unknown or other
  misc_feature (271)..(271): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagatcaccatcacttgccggccagtcagagtatagtactggttgcctggtatcagcagaaaccagggaaacncccctaaagcctacctgctactataaggctatcttaaggtttaaggaaaacggttcggggtacccctaagtaccgtaaagggtttcaaggcccgggacgtaggttgggaacttccggtaggggaactagggtaaactttaccgaaccttcctaacccaaacccgtattccgaaacgccgtaaaccgtcccgttaggacccgtaaagtccccgttaggtaacgtttagggttaactttttacggaccttaaaacgttttacttaaccgtacgtaacccctaaaagtaacggttaatacggttaaatttaacgtttacgttaccggtaaccgggtttccggaaacccggtaaaagggtaaccccgtaaaaggggttaacggaaaaacgttaaccgaaaaacgggtaaaccgttggttaccgggacttaaccggactaaccgtacttcttacggtttacctaccgtttaacccg

SEQ ID NO: 356004 - DNA, 513 bp, Homo sapiens
  misc_feature: GZ8MTXP02GG4WP.45.78.H01.1.454.CMB.2.raw
  modified_base (289)..(289): a, c, t, g, unknown or other
  misc_feature (289)..(289): n is a, c, g, or t
  modified_base (313)..(313): a, c, t, g, unknown or other
  misc_feature (313)..(313): n is a, c, g, or t
  modified_base (319)..(319): a, c, t, g, unknown or other
  misc_feature (319)..(319): n is a, c, g, or t
  modified_base (416)..(416): a, c, t, g, unknown or other
  misc_feature (416)..(416): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (448)..(448): a, c, t, g, unknown or other
  misc_feature (448)..(448): n is a, c, g, or t
  modified_base (459)..(459): a, c, t, g, unknown or other
  misc_feature (459)..(459): n is a, c, g, or t
  modified_base (495)..(495): a, c, t, g, unknown or other
  misc_feature (495)..(495): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagcgtgaganctagacgacacggccgtgattacngtgcgngaggcagaagtagtagtttgtagtaggttagttcgtacggtagtggacgtcgtgggcgaggacgacggcgacgtctctcacgctccacacgaccacncgtctccctcgcnccncctccacgacgcaccncgtcggcgacncgcgccgcgcgtcgcgtcgtcgagacgtactctcgngcgcgtcgtgcgcgcgcg

SEQ ID NO: 356005 - DNA, 573 bp, Homo sapiens
  misc_feature: GZ8MTXP02I9LYQ.45.78.H01.1.454.CMB.2.raw
  modified_base (288)..(288): a, c, t, g, unknown or other
  misc_feature (288)..(288): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctgggggctgaggtgaagaagcctggggcctcagtgaaggtctcctgcaaggcttctggatacaccttcaccggctactatatacactgggtncgacaggcccctggacaaggctgagtggatggatggatcgaacctaacaagtggtagacaacaaactatgcaacagtagttcgagggcaggtcacatgaccaggacacgtccatcagacacacgtacccagacgtggagtcgtagagcgaaggctaggagactccgagaaccggacgacccgggtaccgttaggttaaacttaccggttcggtagaccggggaaggtagggtaaccgaaacggggttaacctttaaacggtttagtttttaacggggtttaaggg

SEQ ID NO: 356006 - DNA, 560 bp, Homo sapiens
  misc_feature: GZ8MTXP02GT263.45.78.H01.1.454.CMB.2.raw
  modified_base (272)..(272): a, c, t, g, unknown or other
  misc_feature (272)..(272): n is a, c, g, or t
  modified_base (486)..(486): a, c, t, g, unknown or other
  misc_feature (486)..(486): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcaggctgagatctgacgacacggccgtgtattactgtgcgagaggcaggaattacgatttttggagtggttagttcggacggttatgggtacgtcgtgggggccaaggggaccacgggtcaccgtctccctcacgccctccaccaagggcccatccggtcctccccctggccaccctcctaccaagacgcaccgtcgtcgggggcacgngccggcccgtggggctcggccctgggtccaagggtactaccgttcctcggaactcggctctggcgcggcggtcg

SEQ ID NO: 356007 - DNA, 630 bp, Homo sapiens
  misc_feature: GZ8MTXP02G962J.45.78.H01.1.454.CMB.2.raw
  modified_base (252)..(252): a, c, t, g, unknown or other
  misc_feature (252)..(252): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactaccaggtgcagctggtgcagtcgtggggctggaggtgaagaagccgtggggcctcagtgaggtctctgcaaggcttcnggatacaccttcaccggctactatatacacgtggtgcgacacggcccctaggacgaaggtcttaggagtggagtgggatggactaccaaacctaacaagtggtacggacaacgaaactagtcgacaacgtaaggtaacgtttacgaacggggtcgtaacggggtaccaaccgtagtacggaacccggaaggggaacccacggtacccaagtaccgaacggaccacgaacggtaccctaaacgacggtacggacgtaccgaggacgcgacgggctaggacgtacgtacgtacggaacggacgtaccggccgttagtaacgttcgtggtacgacggaaggacggacgtaacggtaagtttacggttagtttagggtaagg

SEQ ID NO: 356008 - DNA, 586 bp, Homo sapiens
  misc_feature: GZ8MTXP02FSZZC.45.78.H01.1.454.CMB.2.raw
  modified_base (225)..(225): a, c, t, g, unknown or other
  misc_feature (225)..(225): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctnagtgaaggtctcctgcaaggcttctggatacaccttcaccggtctactatatacacgtgggtgcgacaggcccctggacaaggcttgagtggagtggggatggataccaaacctaacgagtggtgacaacaaactatcgacacgaagtagtttcgaggggcagggtacaaccgagtacgaaccgaaggggtaccaccggtacctaactacgaaggaccacgaacgacctaacgaaagtcgggaacgcgtaggaacggcgaacggtcgtaggagaactcgtagaaccggacgaccggtcgtagtaaccgttacgtgcgtacgaaggacggacgacggtaagttacgttagtttaggtaacgg

SEQ ID NO: 356009 - DNA, 612 bp, Homo sapiens
  misc_feature: GZ8MTXP02F3MZP.45.78.H01.1.454.CMB.2.raw
  modified_base (293)..(293): a, c, t, g, unknown or other
  misc_feature (293)..(293): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctcgagtgaaggtctcctgcaaggcttcgtggatacaccttcaccggtctactatactacacgtgggtncgacacggcccctggacaagggtcttggagtggagtgggatggactaccaaaccctaagaagtggtacgacaaacaaacttatcgactaacgaagttaacgtttcgaaggggaccgaagggtaccaacgagtacggaaccgaacggggaaccaccggtaccaacgtacaacgaccaacgacgtacctaacgagtggaacgcgtagaacgcgaggctagagactcgacgacgacgaccggtccgttagttacgttacgtggacgtacggaaggacggtacgtaaacgggttactttacggttaggttttacgggtaaggg

SEQ ID NO: 356010 - DNA, 498 bp, Homo sapiens
  misc_feature: GZ8MTXP02FG6BJ.45.78.H01.1.454.CMB.2.raw
  modified_base (352)..(352): a, c, t, g, unknown or other
  misc_feature (352)..(352): n is a, c, g, or t
  modified_base (385)..(385): a, c, t, g, unknown or other
  misc_feature (385)..(385): n is a, c, g, or t
tcagacgcgatcgacacgaccggtgctcgatttagtgtgagtagtttgggtttggggagtcagacccagtcaggacacagcatggacatgagggtccccgctcagctcctggggctcctgctgctctggctcccaggtgccaaatgtgacatccagatgacccagtctccttccaccctgtctgcatctgtagagacagagtcaccatcacttgccgggccagtcagagtattagaactggtggcctggtatcagcagaaaccagggaaagcccctaagctcctgctctataaggcatctagtttagaaagtggggtcccatcaaggttcagccggcagtggatctgggacngaattcactctcaccatcagcagcctgcagccngatgatttgcaacttatactgccaacagtatgattagttaattcgaacgttcggccaaaggggaccaaggtcgaaaatcaaaacgaactgtggctgcaccatcctgtcttcac

SEQ ID NO: 356011 - DNA, 535 bp, Homo sapiens
  misc_feature: GZ8MTXP02ICCFL.45.78.H01.1.454.CMB.2.raw
  modified_base (406)..(406): a, c, t, g, unknown or other
  misc_feature (406)..(406): n is a, c, g, or t
  modified_base (523)..(523): a, c, t, g, unknown or other
  misc_feature (523)..(523): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagttggttattcggacggtatgggacgtcgtgggggccaaggggaccacgggtcaccgtctcctcncgcctccacacgggccatcgtctcccctggccaccctcctccagtcgccaccctcgtgggggcacgaggcgcccgtgggcctgcctcggtacacggctacttcctcgaatcgctcgngacgcggctcgg

SEQ ID NO: 356012 - DNA, 629 bp, Homo sapiens
  misc_feature: GZ8MTXP02H6PIG.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcaggcagggtcacatgaccagggacacgtccatcagcacagcctacatggagctgagcaggctgagatctgacgacacggccgtgtattactgtgcgagaggcaggaattacgatttttggagttggtattcggacggttagtgggacgttcgtgggggcctaagggggacccacgggtcacccgtctccctcacgccctccacccgaacggggcccaacgtcccgggttccttccccccgtaggccctaaccccctcccgtacccaacgaccgccacccgtcgtacgggggccacgacggccggcccgttacggacctcggcccgttcgggtaccgaaacgggtaccttaaccgtttccctacggtaacgttcccggcgttacccgtaggacggtccggggacgtcgggg

SEQ ID NO: 356013 - DNA, 545 bp, Homo sapiens
  misc_feature: GZ8MTXP02ILZC9.45.78.H01.1.454.CMB.2.raw
  modified_base (399)..(399): a, c, t, g, unknown or other
  misc_feature (399)..(399): n is a, c, g, or t
  modified_base (427)..(427): a, c, t, g, unknown or other
  misc_feature (427)..(427): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaaattacgtatttttggagtggttattcggacgtatggggactcgtgggggccaaggggccacggtcaccgtcncctcagcctcacaggccatcgctccccngccaccctcctccagcgccaccctcgtggggccacgcgcggccctcggggctcggcctcggtacaacgggtacctaacgttccctcgaacgttcgcgttctcggacgcgggcgtcggg

SEQ ID NO: 356014 - DNA, 577 bp, Homo sapiens
  misc_feature: GZ8MTXP02HQU9C.45.78.H01.1.454.CMB.2.raw
  modified_base (272)..(272): a, c, t, g, unknown or other
  misc_feature (272)..(272): n is a, c, g, or t
  modified_base (315)..(315): a, c, t, g, unknown or other
  misc_feature (315)..(315): n is a, c, g, or t
  modified_base (498)..(498): a, c, t, g, unknown or other
  misc_feature (498)..(498): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcgaggctgagatcagacgacgacggcctagtattacgngtagcgagaggactaggtaacttagtagtttttggacggttggtttaacgtcggacggttagtgggacgttcggtgggggaccaaaggggccacggttcaccgtctccgtcacgccctaccgaccgaacggccacgtccgtcctccccgtgccctaccctcctacaacgcgaccaccgtcggngggccacgcgccggccgtcgggctcggcctcggtacaacggtctaccgtctcgaactcgcgttcaggcgcggtcgacgg

SEQ ID NO: 356015 - DNA, 554 bp, Homo sapiens
  misc_feature: GZ8MTXP02H81S8.45.78.H01.1.454.CMB.2.raw
  modified_base (227)..(227): a, c, t, g, unknown or other
  misc_feature (227)..(227): n is a, c, g, or t
  modified_base (252)..(252): a, c, t, g, unknown or other
  misc_feature (252)..(252): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtgggcctnagtgaaggtctcctgcaaggcttcnggatacaccttcaccggctactatatacacgtggtgcgacacggcccctaggacaaggcttgagtggagtgggatggatacaacctaacagtggtgacaacaaactatgacaacagtaagtttacgaggggacagggtcaacagtacgacgagggacacgtcatcacgacacacgcctaacagtaggagctagagacgaggacgaggagatcgacgaacggacgacggtaccgtagttacgttacgtggtcgacggaaggacggacgaaggtaacgttacggtttaaggttttaggtaaggg

SEQ ID NO: 356016 - DNA, 588 bp, Homo sapiens
  misc_feature: GZ8MTXP02JDDH3.45.78.H01.1.454.CMB.2.raw
  modified_base (351)..(351): a, c, t, g, unknown or other
  misc_feature (351)..(351): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtattagtaactggtggctggtatcagcagaaaccagggaaacgcccctaagctcctgctctataaggcatctagtttagaaagtgggtccatcaaggtcagccggcagtgatcgtgggacngatcactctcacatcagcagcctgcagcctgatgtattttgctaaactttattactcgtaccaaactaggttaatgtaagtttaagtttacgtttcggtaaccggtttccggaaccgtaaaacggggtaacccgtaaaagggggttaggaaaaacgttaccgaaaaaccggtaacgtacggttacgggaccttaagacccgaacctacgttccttcggttactttaccgttaacccg

SEQ ID NO: 356017 - DNA, 680 bp, Homo sapiens
  misc_feature: GZ8MTXP02JA0HT.45.78.H01.1.454.CMB.2.raw
  modified_base (222)..(222): a, c, t, g, unknown or other
  misc_feature (222)..(222): n is a, c, g, or t
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
  modified_base (646)..(646): a, c, t, g, unknown or other
  misc_feature (646)..(646): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctgggctnagtgagtctctgcagctcnggatacnccttcaccggctactatatacacgtgggtgcgacacggcccctggacaagggcttaggaggtgggagtggggtatagggacttaccgaaaacccctaaagaagtggggtaggacctaaacaaaacgttatacggaccaacgtaaggtaaacgttttaccggaagggggtaccgaacgggggttaaccaaccgtaacgtacgggaaacccggaacggggaacccgtaacccggtaccccaagtacccgaaacggacctaaaccgaacccggtaccccttaaaccgaaggttacgggtaaccggcgttacggaacgaccggaacggtccgtaggagtacgtacgtaggaacccggacgtaccgggtaccgttaacgttagttaccgtaggtcgacgaagnggacgtaggtaagtttacgtagttttaggtaagg

SEQ ID NO: 356018 - DNA, 539 bp, Homo sapiens
  misc_feature: GZ8MTXP02FTXYH.45.78.H01.1.454.CMB.2.raw
  modified_base (228)..(228): a, c, t, g, unknown or other
  misc_feature (228)..(228): n is a, c, g, or t
  modified_base (339)..(339): a, c, t, g, unknown or other
  misc_feature (339)..(339): n is a, c, g, or t
  modified_base (357)..(357): a, c, t, g, unknown or other
  misc_feature (357)..(357): n is a, c, g, or t
  modified_base (418)..(418): a, c, t, g, unknown or other
  misc_feature (418)..(418): n is a, c, g, or t
  modified_base (426)..(426): a, c, t, g, unknown or other
  misc_feature (426)..(426): n is a, c, g, or t
  modified_base (446)..(446): a, c, t, g, unknown or other
  misc_feature (446)..(446): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctnagtgaaggtctcctgcaaggcttctggatacaccttcaccggctactatatacacgtggtgcgacaggcccctggacaggcttgagtggatgggatggatacaaccctaanaagtggtagcaacaaatntgcacgagtaagttcagggcagggtcacatgacgaggacacgtcatcagcactacgcctanacgtggancgtagacgcgaggctagganagtcgacggaacgacgaccggtccggttagttacgttacgtggtacgacggaaggacggactaagggtaatttacggtagttttgggtaaggg

SEQ ID NO: 356019 - DNA, 536 bp, Homo sapiens
  misc_feature: GZ8MTXP02IIHFD.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaagtggtgcaacaaactatgcacagtaacgtttcgaggggcagggtcacatcgaccgagggacacgtccatcagcacacgcctacagtggagctgagcgaggcgtagagatcgtacgaccgacgaccgggccgttagtactttacgtgtggacggaaggacggacgtaggtaagtttacggttagttttaggtaaggg

SEQ ID NO: 356020 - DNA, 573 bp, Homo sapiens
  misc_feature: GZ8MTXP02H4D4N.45.78.H01.1.454.CMB.2.raw
  modified_base (289)..(289): a, c, t, g, unknown or other
  misc_feature (289)..(289): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtgggcctcagtgaaggtctctgcaaggcttctggatacgaccttcaccggctactatatacactgggtncgacaggcccctggacaagggcttgagtggagtgggataggatacgaaaccctaacaagtggtaggacaacaaacgtatgacaacaagtaagtttcgaggggcaaggggtacaccgatacgacgaggggacacgtccactacgacgcaacacgaccgttacaagttggaacgcgtagaacgcgtaacggcgtaggaacgagtacgacggaacgacgaccgggtcgtagtacgttacgtgtacgcgaaggagacgtagggtaattacggttagtttttaggtagg

SEQ ID NO: 356021 - DNA, 541 bp, Homo sapiens
  misc_feature: GZ8MTXP02JEU4N.45.78.H01.1.454.CMB.2.raw
  modified_base (366)..(366): a, c, t, g, unknown or other
  misc_feature (366)..(366): n is a, c, g, or t
  modified_base (430)..(430): a, c, t, g, unknown or other
  misc_feature (430)..(430): n is a, c, g, or t
  modified_base (437)..(437): a, c, t, g, unknown or other
  misc_feature (437)..(437): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttggagtgggagtgggatggatacgaaaccctaaccgaatgggtgacgacaaaactntgacacagtaagtttcagggcagggtcacatgacgagggacacgtccatcagacacagacctanagtggancgtagacgcgaaggctagagacgtcgacggacgacgacggtaccggtgttaacttacgtcgtgacggaagacggacgaggtaacttacgtaggttttaggtagg

SEQ ID NO: 356022 - DNA, 545 bp, Homo sapiens
  misc_feature: GZ8MTXP02IK32L.45.78.H01.1.454.CMB.2.raw
  modified_base (400)..(400): a, c, t, g, unknown or other
  misc_feature (400)..(400): n is a, c, g, or t
  modified_base (437)..(437): a, c, t, g, unknown or other
  misc_feature (437)..(437): n is a, c, g, or t
  modified_base (535)..(535): a, c, t, g, unknown or other
  misc_feature (535)..(535): n is a, c, g, or t
tcagacgcgatcgacacgaccggtgctcgatttagtgtgagtagtttggggttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgatttttggagtggttattcggacggttatgggacgtcgtgggggccaagggggacacggtcaccgtcncctcagcctccaccaagggcccatcggtccttccccngtccaccctcctaccaagacgccaccctcgtcgggggcacgagccggccctcggggctggccctggtcaacggactacttcctcgaactcgcgttcgngcgcggcgcg

SEQ ID NO: 356023 - DNA, 595 bp, Homo sapiens
  misc_feature: GZ8MTXP02GSRF1.45.78.H01.1.454.CMB.2.raw
  modified_base (295)..(295): a, c, t, g, unknown or other
  misc_feature (295)..(295): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctccgtgcaaggcttcgtggatacaccttcgaccggctactatatacacgtgggtncgacacggcccctggacaagggcttggagtggatgggatggatccaaacctaacagtggtaggacaacaaactatcggacacgagtaacgttcgagggcagggtcacgatcgaaccgaggactacgtaccatacgacgacaacgacgaccttaacgagttagggaacgtcgaggacgacggacggtcgtaggacgtacgttacgacggaaccggtacgaccgggtaccgttagtacgtttaccgaggtacgacggaaggacggacggtaggtaacgttacgttaggtttacgggttaagg

SEQ ID NO: 356024 - DNA, 539 bp, Homo sapiens
  misc_feature: GZ8MTXP02G8QLB.45.78.H01.1.454.CMB.2.raw
  modified_base (247)..(248): a, c, t, g, unknown or other
  misc_feature (247)..(248): n is a, c, g, or t
  modified_base (267)..(267): a, c, t, g, unknown or other
  misc_feature (267)..(267): n is a, c, g, or t
  modified_base (278)..(279): a, c, t, g, unknown or other
  misc_feature (278)..(279): n is a, c, g, or t
  modified_base (285)..(285): a, c, t, g, unknown or other
  misc_feature (285)..(285): n is a, c, g, or t
  modified_base (331)..(331): a, c, t, g, unknown or other
  misc_feature (331)..(331): n is a, c, g, or t
  modified_base (373)..(373): a, c, t, g, unknown or other
  misc_feature (373)..(373): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtcctccttccaccctgtctgcatctgtaggagacagatcacatcattcgccggcagtcagagtatagtactggtgctgtannagcaagaaacgaggaaacnccctaagctcnnctatanagcatcgtaagttagaaagtcgggtaccagtcgaaggtcaggccgnaggtgatcgaggacagaattcactctcacatcacgcagtccngcacgtcgtagtattgttattacgaacttaaacttacttacacgaactaagtagttatagtaacttagttacgtacggtacggtacggaacgaaacggtaacgaaggtaagaaactaacgaaaacgtacgtacgtcgactcgactacgtactcgtactctactccg

SEQ ID NO: 356025 - DNA, 609 bp, Homo sapiens
  misc_feature: GZ8MTXP02H3IW8.45.78.H01.1.454.CMB.2.raw
  modified_base (314)..(314): a, c, t, g, unknown or other
  misc_feature (314)..(314): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgaggatctgacgacacggccgtgtattacngtgcgagagcgaggaattacgtagtttttggagttggttattcggagttatggggacgttgtcgggggaccaaggggaccacgggtccgacccgtcctccgtcgaccgccctcccgacgaaaccggggccctacgtcccgggttccttcccccgtaggcccctaccccgttccctccgaaacgcgacccacccgttggacggggcaacgcggccggcccgtcgggctcggtccgtcggtacgaaacggtcctaccgtttccacggtctccggcgttcgcggcgggcggtacgcgg

SEQ ID NO: 356026 - DNA, 651 bp, Homo sapiens
  misc_feature: GZ8MTXP02I2WKI.45.78.H01.1.454.CMB.2.raw
  modified_base (288)..(288): a, c, t, g, unknown or other
  misc_feature (288)..(288): n is a, c, g, or t
tcagacgcgatcgacacgaccggtgctcgatttagtgtgagtagtttgggtttgggggagcatcacccagcaaccacatctgtcctctagagaatccccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtncgacaggcccctggacaagggcttgagtggagtgggatggatcgaaccctaacaaactgggtacggcaacgaaaacctatcggacaacgaaggaacgttttaccagggggacgtaggggttaccaaccgagtacggaaccggaacggggaccgaaccggttacccaacgttccgaacggacccaacgaacggaccccttaaaccgagttacggggaagcgtacgacggacgtaacggcgttaggagacgtcgtacggaaccggacgaaccggggtcccgtaggttaaacgtttacgtcggttcggacggaaggacggacgtaaacgggtaagtttaacggtagtttttacgggtttaacgggg

SEQ ID NO: 356027 - DNA, 557 bp, Homo sapiens
  misc_feature: GZ8MTXP02FW5AI.45.78.H01.1.454.CMB.2.raw
  modified_base (271)..(271): a, c, t, g, unknown or other
  misc_feature (271)..(271): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatgganctgagcaggctgagatctgacgacacggccgtgtattactgtgcgagaggcaggaattacgagtttttggagtggttattcggacggttagtggacgtcgtggggaccaagggaccacgggtcaccgtctccctcacgcctccaccgaacggccagtccgtcctcccctggccacccgtcctccacgacgcctacccgtgtcggggcacgcgccgccgtggctcgcgtcggtccgaacggtacctacgtccgtacgtaacgtccgcgtcgtggacgcggcgtacgg

SEQ ID NO: 356028 - DNA, 620 bp, Homo sapiens
  misc_feature: GZ8MTXP02HH1NG.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggtaattacgatttttggagttggttagttcgggacggttatgggacgtcgtggggccaaggggaccacggtcaccgtcacctcacgccctccaccgaacgggcccacgtcggtccctcccccgtggcccacccgtccctccaacgacgccacccgtcgtcgggggaccacgacggccgggcccgtggggcctcggcccgttcgggtaccgaaacggggtacccttaccgttcccgttacccggaagtcccggtccgtttacccggtacggtaccggggtccggggtacggtcggg

SEQ ID NO: 356029 - DNA, 611 bp, Homo sapiens
  misc_feature: GZ8MTXP02JVZFV.45.78.H01.1.454.CMB.2.raw
  modified_base (272)..(272): a, c, t, g, unknown or other
  misc_feature (272)..(272): n is a, c, g, or t
  modified_base (288)..(288): a, c, t, g, unknown or other
  misc_feature (288)..(288): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcgaggctgagntctgacgacacggccgtgtattactgtgcgagaggacaggtaattacgtatttttgggagttggttagttcgggacggttagtgggtacgtcggtcggggaccgaaaggggtcccgacggtccgaacccgttcctcccttcgaccgccctacccgacccgaacgggccccacgtccgggttcccttcccccgtggccctacccctcccgtaccgaagacggccacccgtcggtcggggcacgagccggcccgtcgggcctcgccgtacggtcaacggtactaccgtccgtcgaacgtcggtcgtctcggacggccggcgcggg

SEQ ID NO: 356030 - DNA, 554 bp, Homo sapiens
  misc_feature: GZ8MTXP02HTN9F.45.78.H01.1.454.CMB.2.raw
  modified_base (314)..(314): a, c, t, g, unknown or other
  misc_feature (314)..(314): n is a, c, g, or t
  modified_base (482)..(482): a, c, t, g, unknown or other
  misc_feature (482)..(482): n is a, c, g, or t
  modified_base (485)..(485): a, c, t, g, unknown or other
  misc_feature (485)..(485): n is a, c, g, or t
  modified_base (502)..(502): a, c, t, g, unknown or other
  misc_feature (502)..(502): n is a, c, g, or t
  modified_base (542)..(542): a, c, t, g, unknown or other
  misc_feature (542)..(542): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagtttcaggcagggtcaccatgacagggacacgtccatcagcacagcctacatggagctgagcgagcgtgagatctgacgacacggccgtgtaattctgtcgngagagcaggtaattcgtagtttggtagtggttagttcggtacggttatgggacgtcgtggggacctaaggggccgaacggtccaccgttctcctcgacgcccacccaccgaacgggccctaacgtccggtccctaccccgtcgcctaccctcctaccagacgccaccncgngggcacgcgcgtcccgngcgtcgcgtcgacgacgtctacctcgtcgcgtcgcgtcgngcggcggcgtcg

SEQ ID NO: 356031 - DNA, 674 bp, Homo sapiens
  misc_feature: GZ8MTXP02JB7SA.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggtaattacgtagtttttggagttgggtttatttcgggaacggttagtcggggtacgtcggtcgggggacccaaagggggaccctacgggtcccacccggtcctcccgtcacgccctacccaccgaaccggggccccaacgttcccgggtccccgtttccccccgtcgggtaccccctacccccttccccgttacccgaaacggtccgacccgtaccccgtccgggtcgggggccaaccgccgggtcccgggccccgttcgggggcctcggcccgtacgggtaccgaacgggtaccttaaccgttccgtaccgcgttccggccgttcgtcggccggcggggtcgtcgggg

SEQ ID NO: 356032 - DNA, 621 bp, Homo sapiens
  misc_feature: GZ8MTXP02FOKO0.45.78.H01.1.454.CMB.2.raw
  modified_base (271)..(271): a, c, t, g, unknown or other
  misc_feature (271)..(271): n is a, c, g, or t
  modified_base (478)..(478): a, c, t, g, unknown or other
  misc_feature (478)..(478): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcacatgaccagggacacgtccatcagcacagcctacatgganctgagcagctgagatctgacgacacggccgtgtattactgtgcgagaggcaggaattacgatttttggagtggttattcggacggttatgggacgtctgggggccaaggggaccacgggtcaccgtctcctcagcctcaccaggcccagtcgtcttcccctaggccaccctcctccaacgtacgccacccgtcgtcgggggccaacnggcccggcccgtgggggccttcggccccgtttcggggttacccgaaaacggggtaccctttaaacccgtttcccgtaccggtaaacgttcccggtacccggttccgttacggaacgggtcccgggggtacggttacccggggg

SEQ ID NO: 356033 - DNA, 516 bp, Homo sapiens
  misc_feature: GZ8MTXP02GJV88.45.78.H01.1.454.CMB.2.raw
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (477)..(477): a, c, t, g, unknown or other
  misc_feature (477)..(477): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggccccctggacaagggcttgagtggatgggtatggatccaaaccctaaccaatggtaggacaacaaaactatgacaacagaaagtttcagggcagggtcaccatgaccaggacacgtccatcagcacagcctacagtggancgngagcgaggctagagatcagacgacacggcgtagtattacngtgacgaagacgcaggtaagttacgtagttttggtaagg

SEQ ID NO: 356034 - DNA, 621 bp, Homo sapiens
  misc_feature: GZ8MTXP02H2G0Z.45.78.H01.1.454.CMB.2.raw
  modified_base (253)..(253): a, c, t, g, unknown or other
  misc_feature (253)..(253): n is a, c, g, or t
tcagacgcgatcgacacgaccggtgctcgatttagtgtgagtagtttgggtttgggggagcatcacccagcaacccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctgagtgaaggtctcctgcaaggcttntggatacaccttcaccggctactatatacacgtgggtgcgacacggccccgtggacgaagggcttaggaggtggagtgggatagggactacaaccctaagaagtgggtacggacaaacaaacgttatgacaactaacgtaagtttcgaggggacaggggtaccaacgagtacgaccgaagggaccaacgtaccacgtcagacacaacgaccgtacacgtggacgtcgtagacgccgaaggcgtaggaagagtacgtacggaaccgacggaccgggtccgtttaggaactttaacggtcggttaggaccggaaggacgggtaacgaagggttaaacgtttacggtttaaggtttttagggttaaagggg

SEQ ID NO: 356035 - DNA, 491 bp, Homo sapiens
  misc_feature: GZ8MTXP02JVL5W.45.78.H01.1.454.CMB.2.raw
  modified_base (356)..(356): a, c, t, g, unknown or other
  misc_feature (356)..(356): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (419)..(419): a, c, t, g, unknown or other
  misc_feature (419)..(419): n is a, c, g, or t
  modified_base (440)..(440): a, c, t, g, unknown or other
  misc_feature (440)..(440): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactggtgcgacaggcccctggacaagggcttggagtggatggatggatcaacctacaatgtgcacaaactatgacanagaagttcagggcagggtcacatgaccaggacacgtcatcagcacagcctangtganctgagngagcgagagatcgagacgacncgcgtagtactacgtgcgagaagaggacaggtatacgtagtttaggtacgg

SEQ ID NO: 356036 - DNA, 628 bp, Homo sapiens
  misc_feature: GZ8MTXP02JUSQV.45.78.H01.1.454.CMB.2.raw
  modified_base (251)..(251): a, c, t, g, unknown or other
  misc_feature (251)..(251): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacgagggataggaaacnctcacttgaattggttacaacagacggccaggccaatcctccgaaaggccgtaccttaaattttagtaaggtttacctaaaccgggacttcggtcggggtaccccagacagtacttcgagcggccaggtgggtacaggcacgtgtattcactactagaaaattggaagggtcgagcgtaggaggtagtggttggtagtttacttcgtgtactatgacgtaaggtactacgtacgtggtaccgttaacgtacgttttacggaccgtaaggggaccctaaaggtccgtaagggtaaaactaccgaaaacggtaacgtggttacggacttcggacctaccgtaactcgtacgttaccttcacgttcccttaccgactacg

SEQ ID NO: 356037 - DNA, 513 bp, Homo sapiens
  misc_feature: GZ8MTXP02HTZDT.45.78.H01.1.454.CMB.2.raw
  modified_base (374)..(374): a, c, t, g, unknown or other
  misc_feature (374)..(374): n is a, c, g, or t
  modified_base (459)..(459): a, c, t, g, unknown or other
  misc_feature (459)..(459): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggagtgggatggatcaaaccctaaccaagtggtggcacaaacctatgcaacagagtttnaggggcaggggtcaccagtgacgaggacacgtccatcagcacagacctacatggagctgagcgaggcgtgagacgtcagacgacncggccgtgtattacgtgtgcgaaggagacgaggacttacgtagttttggtaagg

SEQ ID NO: 356038 - DNA, 677 bp, Homo sapiens
  misc_feature: GZ8MTXP02GLSMR.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcgagtgaaggtctcctgcaggtcttcgtggatacacccttcaccggctactatatacacgtgggtcgcgacgacggcccctggaacgaaggcttggagtgggagtggggataggactaccgaaaccctaacgtaagtcgggtaggacaaacctaaaacgttagtacggaccaaacgtaaggtaaacgtttaccggaagggggaccgtacggggttacccaaccgtaacgttacggaaacccggaacgggggaacctacccgggtaccctaacgtacccgaacggacccaaaccgtaccgacccgttaaaccgaggttacgggacgacggtacgacgggaccgagggctaaggatacgtcgaggaaccgaccggacggtccgttagtacgttacgtcgtacgacggaaggacgacggtaaggtaagttacggttaagtttacgggttaagg

SEQ ID NO: 356039 - DNA, 526 bp, Homo sapiens
  misc_feature: GZ8MTXP02GZTUG.45.78.H01.1.454.CMB.2.raw
  modified_base (252)..(252): a, c, t, g, unknown or other
  misc_feature (252)..(252): n is a, c, g, or t
  modified_base (288)..(288): a, c, t, g, unknown or other
  misc_feature (288)..(288): n is a, c, g, or t
  modified_base (432)..(432): a, c, t, g, unknown or other
  misc_feature (432)..(432): n is a, c, g, or t
  modified_base (440)..(440): a, c, t, g, unknown or other
  misc_feature (440)..(440): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttcnggatacaccttcaccggctactatatacactgggtncgacaggcccctggacaaggcttgagtggatgggatggatcgaaaccctaacaaacgtggtaggcaacaaactatcgcacaagaagtttcgaggggtcagggtacaccagtgaaccaggacacgtccatcagcaacgagcctanacgtggancgtagagcgaggcagagatcgagacgacgacggccgtagtactacgtgtcgagaagagcgaaggtaacttacgtagtttggtaagg

SEQ ID NO: 356040 - DNA, 570 bp, Homo sapiens
  misc_feature: GZ8MTXP02JLIZG.45.78.H01.1.454.CMB.2.raw
  modified_base (357)..(357): a, c, t, g, unknown or other
  misc_feature (357)..(357): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctctgcaaggcttctggatacaccttcaccggctactatatacacgtgggtgcgacacggcccctggacgaaggcttggagtggagtgggatggatcaacctaacagtggcgacaacaaactntgacacagtaacgttgagggcagggtacacgatcgacgagggacacgtaccatacgagacacgacgacctaacgagtggagcgtagacggaccgagggtctaggagacgtcgacggaacgacggaccgggtaccgttaggttacttacggtggtaccggacggaacggaggaccgtaaaggtaacgtttacggtttaggttttaggttaaggg

SEQ ID NO: 356041 - DNA, 606 bp, Homo sapiens
  misc_feature: GZ8MTXP02IWN95.45.78.H01.1.454.CMB.2.raw
  modified_base (188)..(188): a, c, t, g, unknown or other
  misc_feature (188)..(188): n is a, c, g, or t
  modified_base (267)..(267): a, c, t, g, unknown or other
  misc_feature (267)..(267): n is a, c, g, or t
  modified_base (273)..(273): a, c, t, g, unknown or other
  misc_feature (273)..(273): n is a, c, g, or t
  modified_base (317)..(317): a, c, t, g, unknown or other
  misc_feature (317)..(317): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaanaatggtggacacaaactatgcacagaagtttcagggcaggtcaccatgaccgaggacacgtccatcagcacagccctanatgganctgagcaggctgagatctagacgacacggccgtagtatttacgngtgacgagagacgtaagtaattacgttagtttaggagtttagttacgtcgggtagttacgtgggtacgtcggtacgggaccgaacgggaccgtacgtcctaccgtctccacacgcccgtaccgaaccgaccggcctacgtccgtaccctccccgtacgccctaccctacctacgacgacgaccgaccgtcggacgggacacgcgccggccgtcggctcgtccgtacgtacgtaacgtaccttaccttccgtacgtaacgtcgtcgtacgtcggacggtcggacgtacgg

SEQ ID NO: 356042 - DNA, 549 bp, Homo sapiens
  misc_feature: GZ8MTXP02GREVR.45.78.H01.1.454.CMB.2.raw
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (367)..(367): a, c, t, g, unknown or other
  misc_feature (367)..(367): n is a, c, g, or t
  modified_base (419)..(419): a, c, t, g, unknown or other
  misc_feature (419)..(419): n is a, c, g, or t
  modified_base (437)..(437): a, c, t, g, unknown or other
  misc_feature (437)..(437): n is a, c, g, or t
  modified_base (502)..(502): a, c, t, g, unknown or other
  misc_feature (502)..(502): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctgagtgaagtctctgcaggctnggatacnccttcaccggctactatatacactgggtgcgacacggcccctggacgaagggcttggacgtgggagtgggatgggactccgaaaccctaacgaacgtggtacgacaacaaactntgacaacagtaagttcgagggacagggtacacgatgacgaggacacgtccanacagacacagaccctaanagtggagcgtagacgacgaggcgtagacgtacgtcgagacgacgacggtcctagtaactttccgngtgacgaagacggacgtaagtaacgttacggttacggtttaggtagg

SEQ ID NO: 356043 - DNA, 557 bp, Homo sapiens
  misc_feature: GZ8MTXP02FQYBY.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactggtgcgacaggcccctggacaaggcttgagtggatgggatggataccaacctaacaagtggtacggacaacaaaacttatcgacaacgtaggtaaagtttcgaacgggggcacggggtacaaccgatacggaaccgagggaaccgacgtaccaagtcgacgaccacacgacctagacgtggacgctaggacgcgaggcgtagagactcgagacgacgacggccgtagtatacgtgtgcgaaggcgacgaggtaattacggtagttttagggtagg

SEQ ID NO: 356044 - DNA, 553 bp, Homo sapiens
  misc_feature: GZ8MTXP02HEJZG.45.78.H01.1.454.CMB.2.raw
  modified_base (253)..(253): a, c, t, g, unknown or other
  misc_feature (253)..(253): n is a, c, g, or t
  modified_base (471)..(471): a, c, t, g, unknown or other
  misc_feature (471)..(471): n is a, c, g, or t
  modified_base (510)..(510): a, c, t, g, unknown or other
  misc_feature (510)..(510): n is a, c, g, or t
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtagaaaggaagccgtggggcctgagtgaaggtctctgcaggcttngatacaccttcaccgctactatatacacgtgggtgcgacacggcccctggacgaaggcttggagtgggagtgggatggataccaaacctaacgaagtggtaggacaactaaactagtgacaacgaagtaagtttacgagggcaagggtacacagtacgaaccgaggacacgtacatacacgacaacacgacctacgagtggagcgagacgacgaggcnggagagtcacggacgacgacggtccgtagtacgttacgngtgacggaagaggacgaggtaagttacgttagttttaggaggg

SEQ ID NO: 356045 - DNA, 674 bp, Homo sapiens
  misc_feature: GZ8MTXP02GBWEL.45.78.H01.1.454.CMB.2.raw
  modified_base (272)..(272): a, c, t, g, unknown or other
  misc_feature (272)..(272): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatgganctgagcaggctgagatctgacgacacggcgtgtatactgtgcgagaggcaggaattacgtatttttggagttaggtttagttacggacggttagtgggtacgtcggtgggggaccgaaggggacccgtacgggtccacccggtctacccgtcacgccctccgacccgaacggggccctaacgtccggttcccttcccccgtgggccctacccccgtcccttacccgaaacggaccggacctaccccgttcggtacgggggacccaaacgccgggcccgggccccgttacgggggccttcgggaccgttcgggttaacgaaaccgggtaccgttaacctttcccgttaaccggaagttcccggtacggttaccgtccggaagggcccggggtaccgtcggggg

SEQ ID NO: 356046 - DNA, 598 bp, Homo sapiens
  misc_feature: GZ8MTXP02GIZOB.45.78.H01.1.454.CMB.2.raw
  modified_base (190)..(190): a, c, t, g, unknown or other
  misc_feature (190)..(190): n is a, c, g, or t
  modified_base (450)..(450): a, c, t, g, unknown or other
  misc_feature (450)..(450): n is a, c, g, or t
  modified_base (461)..(461): a, c, t, g, unknown or other
  misc_feature (461)..(461): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggngcagtcgtggggctggaggtgaagagccgtggggcctcgagtgaaggtctcctgcgaggtcttcgtaggatacctaccttcgaccggtctactatatacacgtgggtcgacgacacgggtcccctaggaacgaggtctggagtggagtggatggatccgaaacctacaagtggtacgacacaaactgtgacacgaagtacggttcgagggcgacgggtacacgtagtacgaccgagggacccacgtccatcgagaccaanacgtaccctanacgtggacgacgtaggacgcgagcgaggacgtagtcgacggaacgaccggacggtaccgttagtaaccgttcgtacggtaggacgaaggaacggtacgtagggttaaattacggtttaggttttagggttaaagggg

SEQ ID NO: 356047 - DNA, 592 bp, Homo sapiens
  misc_feature: GZ8MTXP02IEXMI.45.78.H01.1.454.CMB.2.raw
  modified_base (376)..(376): a, c, t, g, unknown or other
  misc_feature (376)..(376): n is a, c, g, or t
  modified_base (383)..(383): a, c, t, g, unknown or other
  misc_feature (383)..(383): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcgagtcgtggggctggaggtgaagaagccgtggggcctcgagtgaggtctctgcaaggcttctggatacaccttcaccggctactatatacacgtggtgcgacacgggcccctaggaccgaagggtcttaggaggtggagtggggatggataccaaacctaacaagtggtacggacaacaaactntgacaanagtaaagtttcgaggggcagggtcacgagtacgacgaggacacgtacatcagacacgacgacctacgagtaggacgtcgagacgcgaggcgtggagtacgtacgtacggaaccggacgtaccgggtccgttaggtacgtttaccgtggttcgacggaaggacggaacgtacgggttaaagtttacggtttaggtttttagggtaagggg

SEQ ID NO: 356048 - DNA, 562 bp, Homo sapiens
  misc_feature: GZ8MTXP02JTRQO.45.78.H01.1.454.CMB.2.raw
  modified_base (249)..(249): a, c, t, g, unknown or other
  misc_feature (249)..(249): n is a, c, g, or t
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtgggcctcgagtgaggtctctgcaggcttcnggatacaccttcaccggctactatatacacgtgggtgcgacacggcccctggacaaggcttggagtggagtgggatggataccaacctaacagtggngacacaaatntgacacagtagttcgagggcagggtacaccagtcgacgagggacacgtcatacgagcacacgcctaancgtagancgtagacgcgaggcgtagagtacgtacgacgaaccgacggaccggtacccgttagttaacgttaccgtggtacggcggtaaggacgggtaacgtaagggtaaacgtttacgtttaggttttaggttaaggg

SEQ ID NO: 356049 - DNA, 504 bp, Homo sapiens
  misc_feature: GZ8MTXP02IJJAT.45.78.H01.1.454.CMB.2.raw
  modified_base (403)..(403): a, c, t, g, unknown or other
  misc_feature (403)..(403): n is a, c, g, or t
  modified_base (417)..(417): a, c, t, g, unknown or other
  misc_feature (417)..(417): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggggcctcagtgaaggtctcctgcaaggcttctggatacacttcacggctactatatacactggtgcgacaggcccctggacaaggcttgagtggatggatggatacgaacctaccaatggtgacacaaactatgcacagtaagtttcgagggcagggtacacatacgacgagggacacgtcancaagcacagcctanatgagacngagcgagngagagagacgagacgacgacgacgtacgtactacgtcgtgagaagagacgacgtagtacgtacgttagtag

SEQ ID NO: 356050 - DNA, 697 bp, Homo sapiens
  misc_feature: GZ8MTXP02GT0YC.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatcgtgacgacgacggccgtgtattactgtgcgagaggcaaggaattacgagtttttggagtttcggtattcgggacggttagtggggacgttcggtcgggggaccgtaaaggggacccgtacgggtacccgtaacccgtcctcccgtacaacggtcccctacccgaaccgaaccggggaccccacgttcccggtcccttcccccgtcgggaccctacccctccctaccgaaacgacgaccctaacccgttcggccgggggaccaaacggcggcccggggtccccgtcggggccgtccgggtccttaccggggtaccgtaaacggggtaacccttcccgtttacccgtaccggtaacgttcccggtaccggttcccgttagggtacgggcccggggtcgttaaccggggg

SEQ ID NO: 356051 - DNA, 593 bp, Homo sapiens
  misc_feature: GZ8MTXP02FJVUT.45.78.H01.1.454.CMB.2.raw
  modified_base (404)..(404): a, c, t, g, unknown or other
  misc_feature (404)..(404): n is a, c, g, or t
  modified_base (446)..(446): a, c, t, g, unknown or other
  misc_feature (446)..(446): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggcgtgagatctagacgacacggccgtgtattactgtgcgagaggcaggaattacgatttttggagtggttattcggacggttatgggacgtcgtgggggaccaagggaccacggtcaccgtcncctcagccctccaccgaacgggcccatccggtccttcccccnggcccacccgtccctccaacgacgccacccgtcgtcgggggccaacgcgccggccctgggggcctcggtcccgtcggtaccgaaacgggtaccttaaccttcccgttcggaactccggtccgttcgtcggacggccgggcgtcgggg

SEQ ID NO: 356052 - DNA, 565 bp, Homo sapiens
  misc_feature: GZ8MTXP02GKGWQ.45.78.H01.1.454.CMB.2.raw
  modified_base (252)..(252): a, c, t, g, unknown or other
  misc_feature (252)..(252): n is a, c, g, or t
  modified_base (288)..(288): a, c, t, g, unknown or other
  misc_feature (288)..(288): n is a, c, g, or t
  modified_base (465)..(465): a, c, t, g, unknown or other
  misc_feature (465)..(465): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagcctggggcctcagtgaaggtctcctgcaaggcttcnggatacaccttcaccggctactatatacactgggtncgacaggcccctggacaaggcttgagtggatggggatgggatccaaccctaacaagtgggtaggacaacgtaaaactgtcggacaacgaggtaaacgtttcgaaggggcaggggtaccaaccgtagtcgaaccgaggggaaccacggtcccaatcgagcacagccctaagagtggancgtagagcgaggcgtgagagtcgagaccgacgacggtccgtagtaagttcgtaggtgacgaaggacggacgaagggtactttacggtagtttttaggagg

SEQ ID NO: 356053 - DNA, 569 bp, Homo sapiens
  misc_feature: GZ8MTXP02IHCHJ.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtatactgtgcgagaggcaggtaattacgtagtttttgggagttaggttattcgggacggtagtgggacgtcgtgggggaccaaggggaccacggtcaccgtctcctcacgcctcccaccacgggcccacgtccgtcctccccgtcgccaccctccctccagcgccaccgtcgtcgggggcacgcgccggcccgtcgggcgtcgccgtcggtccgaaacggtacctaccgttcctcgaacgtcgcgtcgtcgacggcggcgtcgg

SEQ ID NO: 356054 - DNA, 540 bp, Homo sapiens
  misc_feature: GZ8MTXP02H4CMI.45.78.H01.1.454.CMB.2.raw
  modified_base (406)..(406): a, c, t, g, unknown or other
  misc_feature (406)..(406): n is a, c, g, or t
  modified_base (519)..(519): a, c, t, g, unknown or other
  misc_feature (519)..(519): n is a, c, g, or t
  modified_base (522)..(522): a, c, t, g, unknown or other
  misc_feature (522)..(522): n is a, c, g, or t
  modified_base (531)..(531): a, c, t, g, unknown or other
  misc_feature (531)..(531): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtattactggtgcgagaggcaggaattacgtagtttttggagttggttattcggacggttagtgggacgttgtgggggccaaggggccacggtcaccgtcncctcagccctcaccacgggcccacgtccggtccttccccgtggccctacccctcctccaagacgcacctcgcggggcacgcgcgccgtggctcgacctgcgaacgtctactcncgngtcgctcgngcgcgcgcg

SEQ ID NO: 356055 - DNA, 724 bp, Homo sapiens
  misc_feature: GZ8MTXP02JAWGO.45.78.H01.1.454.CMB.2.raw
  modified_base (250)..(250): a, c, t, g, unknown or other
  misc_feature (250)..(250): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacgagggatggaaacnctcacttgaattggttacaacagacggccaggccaatcctaccaaggcctaccttaaattttacgtaacggtttcctaaaccggggacttcggtacggggttaccccaagtaccgtagtacttccgaaggtccggaccctaagggtcggggtaccaaggggcctaaccgttggtacctttaccaactaaccgttaaagtaaaaagtttacggggtaaggggtgggtaaaggtcgtaggaaggtagttaggtttaggtagttttagtttcgtaggtctagtcgacgtaaacggttaccacgtacgtacggtacccgttaacgtaccgttttacgggaccgtaacggggtaacccgtaaggtacgtaacgggtaaaacttaaccgaaaacggtaaccgtaggtacggtacgttacggaccgtaacctaacttcgttcgttaccgtttactacctttccgttccccgtacgttaccg

SEQ ID NO: 356056 - DNA, 573 bp, Homo sapiens
  misc_feature: GZ8MTXP02ID3XL.45.78.H01.1.454.CMB.2.raw
  modified_base (197)..(197): a, c, t, g, unknown or other
  misc_feature (197)..(197): n is a, c, g, or t
  modified_base (272)..(272): a, c, t, g, unknown or other
  misc_feature (272)..(272): n is a, c, g, or t
  modified_base (283)..(283): a, c, t, g, unknown or other
  misc_feature (283)..(283): n is a, c, g, or t
  modified_base (291)..(291): a, c, t, g, unknown or other
  misc_feature (291)..(291): n is a, c, g, or t
  modified_base (347)..(347): a, c, t, g, unknown or other
  misc_feature (347)..(347): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttcggccgggcagtcagagtattagtactggtgctggtatcagcagaaaccaggaaacnccctaagctcngctactanaaggcatcttagttaaggaaaggtcgggtacccagtacgaaggttcaggcccgganaggtgattcgtgggacagtaattcactctacacatcagcacgcctgcagccgtagattagtatttcgaacttaaacgttatttacgacgtaaccaactagttatagtaatttagttacgttcggtaccggttaccggaacgaaacggggaccaaaagggtacgaaaactacgaaaacgtacgtaggtacggcaacggaccacgtactccttgtaccttctaacccg

SEQ ID NO: 356057 - DNA, 569 bp, Homo sapiens
  misc_feature: GZ8MTXP02HRL07.45.78.H01.1.454.CMB.2.raw
  modified_base (299)..(299): a, c, t, g, unknown or other
  misc_feature (299)..(299): n is a, c, g, or t
  modified_base (460)..(460): a, c, t, g, unknown or other
  misc_feature (460)..(460): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggcgtgagatcagacgacncggcgtgtatacgtgtgcgagagcaggtattacgtagttttggagttggttagttcggacggttatcggggtacgttcgaggggccgaaaggggtaccgacggtccaccgtcctcctcgacgccctccgaccgaacgggcccacgtccggtcccttccccnggccctaccctcctaccaacgacgccaccgcgtcgggcgacgcgcgccgcggtcgtcgcgtcggtcgacgtacgtaccgtcctcgtcgtcgcgtcgcgcggcggcgcgg

SEQ ID NO: 356058 - DNA, 600 bp, Homo sapiens
  misc_feature: GZ8MTXP02GQI76.45.78.H01.1.454.CMB.2.raw
  modified_base (249)..(249): a, c, t, g, unknown or other
  misc_feature (249)..(249): n is a, c, g, or t
  modified_base (320)..(320): a, c, t, g, unknown or other
  misc_feature (320)..(320): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacnctcacttgaattggttcaacagaggccaggccaatctaccaaggcacctaatttataaggtttcaaccggntcgtgggtcccagacagattcagcggccaggtgggtcaggctactgactttcaactactagaaaattggtaggggtggagtcgtaggaggtagttggttaggtagtttagttcgtagctagtgacgtaaaggtacacgtacgtcggaccgtactacgtttacggaccgtaaggggacccaaggtcgtaaggtaaaactacgaaaacgtacgtaggtacggactcggacctaaccgtaagtccttcgttaccttactaacttccctttaccccgacttaac

SEQ ID NO: 356059 - DNA, 543 bp, Homo sapiens
  misc_feature: GZ8MTXP02G0YBV.45.78.H01.1.454.CMB.2.raw
  modified_base (369)..(369): a, c, t, g, unknown or other
  misc_feature (369)..(369): n is a, c, g, or t
  modified_base (436)..(436): a, c, t, g, unknown or other
  misc_feature (436)..(436): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccggctactatatacactggtgcgacacggcccctggacaagggcttggagtggagtgggatggatacaaccctaacaagtggtaggacaacaaactatgacanaagaagttcgaagggcagggtcaccagtcgaacgagggaacacgccatcagcacagcctacatggancgtagacgcgaggctaggagagtcgagaaccgacgaacggtccgttagtactttacgtgtggacgaacggaggacaacgggtaattacggttagttttaggtaaggg

SEQ ID NO: 356060 - DNA, 554 bp, Homo sapiens
  misc_feature: GZ8MTXP02HGI9S.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaggtctctgcaggcttctggatacaccttcaccggctactatatacactgggtgcgacaggcccctggacaaggcttgagtggagtgggatggatcaacctaaccagtggtaggacaacaaactagtgcaacagtaagttcgagggtcagggtacaccagtcgaccgaggacacgtcagtcagcacgagacctacgagttggacgcgtagacgcgaggctagaggtactacgacggaacgacggaacggtccgtagtaacgttacgtggtacgacgaagggtaggacgtaagggtaacttacggtttaacgttttaggtaacgg

SEQ ID NO: 356061 - DNA, 552 bp, Homo sapiens
  misc_feature: GZ8MTXP02F16EB.45.78.H01.1.454.CMB.2.raw
  modified_base (468)..(468): a, c, t, g, unknown or other
  misc_feature (468)..(468): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcgagtgaaggtctcctgcaaggcttctggataccaccttcaccggctactatatacactgggtgcgacacggcccctggacaagggcttggagtggatggggatggatacaacctaacaagtggtagacaacaaaactatgacaacgaagtaagtttcgagggcgagggtacaccatcgaacgaggacacgtccatcagcacagcctacatggagctagagcgagggctaggaagacgtacgngaaccgaccgacggtccgtagttacttacgtcgtaggcgaaggacggacgtaaggaatttaacgttaagtttttagggtaacgg

SEQ ID NO: 356062 - DNA, 631 bp, Homo sapiens
  misc_feature: GZ8MTXP02HUTT6.45.78.H01.1.454.CMB.2.raw
  modified_base (482)..(482): a, c, t, g, unknown or other
  misc_feature (482)..(482): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgacgatctgacgacacggccgtgtattactgtgcgagagcgtaggaattacgtagttttggagttggttattcggacgttagtggtacgtcgtagggggacctaaggggccacggttcaccggtctcccgtacgacgccctaccaccgaacgggccctaagtccgtacctccccgtgcccaccctcctaccacggtacnccgtaccgtcgtcggggaccacgacgggtccggcccgtagggtcctacggtaccgttacgggtacgtaaaacggtacccttaaccgtttcccgtacggtaaccgtcggtaccgttcgttacggacggtccgggtcgttaaacccggggg

SEQ ID NO: 356063 - DNA, 579 bp, Homo sapiens
  misc_feature: GZ8MTXP02I863A.45.78.H01.1.454.CMB.2.raw
  modified_base (253)..(253): a, c, t, g, unknown or other
  misc_feature (253)..(253): n is a, c, g, or t
  modified_base (374)..(374): a, c, t, g, unknown or other
  misc_feature (374)..(374): n is a, c, g, or t
  modified_base (544)..(544): a, c, t, g, unknown or other
  misc_feature (544)..(544): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaggtctctgcaggcttcgnggatacaccttcaccggctactatatacacgtgggtgcgacgacggcccctaggaacgaagggcttggaggtgggagtgggatggactacaaaccctaacagtggtacggacaacaaactntgaccaacgtagtaacgttacgacgggcgacgggtacaccgagtacgaaccgagggaccacgtcccaatcaagacacgacgacctaacagtaggacgcgtagacgcgacggcgtagaggtactcgaaggacgacgaccggtaccgtagtaacgttcgtgtacgagaaggnggacgtaggtaacgttacggttagtttaggtaagg

SEQ ID NO: 356064 - DNA, 660 bp, Homo sapiens
  misc_feature: GZ8MTXP02GGK9E.45.78.H01.1.454.CMB.2.raw
  modified_base (430)..(430): a, c, t, g, unknown or other
  misc_feature (430)..(430): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgacaggacacgtccatcagcacagcctacatggagctgagcgaggctgagatctagacgacacggccgtcgtatactgtcgcgaggagacgagtaaagttacgtagttttggagttggttattcggtacggtagtgggtacgtcgtagggggaccgaagggaccgacggtcgacccgtcgtaccctcacgtcccnccaaccgacgggcccacgttccggtacccttcccccgttcggccctacccctcccgtacccgaacgtaaccgcccgtaaacccgtccggtacgggggacccaacggaccggcccggggccccgttcgggcccgtttcggcccggtttacgggtaccgaaacgggtaccttaaccgttcccgttaccggaactccggtcgtcccgttagcgggtaccgggtcgtaacgggg

SEQ ID NO: 356065 - DNA, 559 bp, Homo sapiens
  misc_feature: GZ8MTXP02JTLUW.45.78.H01.1.454.CMB.2.raw
  modified_base (253)..(253): a, c, t, g, unknown or other
  misc_feature (253)..(253): n is a, c, g, or t
  modified_base (374)..(374): a, c, t, g, unknown or other
  misc_feature (374)..(374): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcagtgaaggtctcctgcaaggcttcnggatacaccttcaccggctactatatacacgtgggtgcgacacggcccctggaaccaagggcttggagtgggagtgggatggactaccaaacctaacgaagtggtaggaccaacgaaactntgacaacagtaagttcgagggcagggtcacatgaccgaggacacgtccagtcagcacacgcctacagtggacgcgtagacgacgaggctagagtactcgagaccgacgaccggtaccgtagtaacgttacgtggtcgacgaaggacggacgtaaacgggtaatttacggttagtttagggtaagg

SEQ ID NO: 356066 - DNA, 617 bp, Homo sapiens
  misc_feature: GZ8MTXP02G7U9C.45.78.H01.1.454.CMB.2.raw
  modified_base (244)..(244): a, c, t, g, unknown or other
  misc_feature (244)..(244): n is a, c, g, or t
  modified_base (250)..(250): a, c, t, g, unknown or other
  misc_feature (250)..(250): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtgggcctgagtgagtctctgcagctngatacnctcacgctactatatacacgtggtcgcgacgacggcccctggaaccgaagggtcttaggaggtgggagtggggataggactaccaaacctaaccgaagtggtacggaccaaactaaaacctgtcgacaaacgtaaggttaacgtttacggaagggggactaacggggtaccaaccgtaagtacgaaacccggaacgggaacccgtaaccggtacccaagtaccgaacgaccaacgtaaccggacccttaacgaaggttcgggactacgtaggaacggtccgagggcgtaggagtacgtacacggacgacgcggacgtagtaacgtcgagtcgacggaagcgagaagtacgtagttagtttaggtagg

SEQ ID NO: 356067 - DNA, 583 bp, Homo sapiens
  misc_feature: GZ8MTXP02I2I0M.45.78.H01.1.454.CMB.2.raw
  modified_base (569)..(569): a, c, t, g, unknown or other
  misc_feature (569)..(569): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgagtttttggagttggttattcgggacggtatgggacgtcgtggggaccgaagggaccacggtcacccgtctcctcacgcctccaccgacgggcccagtccggtccttcccccgtcggccctacccgtccctaccgaacgacgcccaccgttccggcgggggccaacgcgccgggccctgggcctcgccgtcggtacgaacggaccttaccttccgtcgaacttccggcgttccggnggacggcggcgcgg

SEQ ID NO: 356068 - DNA, 563 bp, Homo sapiens
  misc_feature: GZ8MTXP02HV6EC.45.78.H01.1.454.CMB.2.raw
  modified_base (247)..(247): a, c, t, g, unknown or other
  misc_feature (247)..(247): n is a, c, g, or t
  modified_base (323)..(323): a, c, t, g, unknown or other
  misc_feature (323)..(323): n is a, c, g, or t
  modified_base (338)..(338): a, c, t, g, unknown or other
  misc_feature (338)..(338): n is a, c, g, or t
  modified_base (357)..(357): a, c, t, g, unknown or other
  misc_feature (357)..(357): n is a, c, g, or t
  modified_base (372)..(372): a, c, t, g, unknown or other
  misc_feature (372)..(372): n is a, c, g, or t
  modified_base (422)..(422): a, c, t, g, unknown or other
  misc_feature (422)..(422): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctggggcctcagtgaggtctctgcaaggcttcnggatacaccttcaccggctactatatacacgtgggtgcgacacggcccctggacaagggcttggagtggatggganggactcaaacctaanaatggtggacacgaaactntgcaacagtagtttnagggcagggtcacgatcgaccgagggacacgcatcagcaacacgacctanagtggagcgtagaggccgaggtacgtaggaagactacgtacggacggaacgtacgggaccgttagttaactttacgtcggtacggaggaaggacggacgtaaacgggtaactttaacggttacgtttttagggttaacggg

SEQ ID NO: 356069 - DNA, 614 bp, Homo sapiens
  misc_feature: GZ8MTXP02I6980.45.78.H01.1.454.CMB.2.raw
  modified_base (312)..(312): a, c, t, g, unknown or other
  misc_feature (312)..(312): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattacngtgcgagaggcaggaattacgattttggagtggttattcggacgttatgggtacgtcgtgggggaccaaggggccacgggtcacccgtctccctcacgcctccgaccaacgggccccagtccgggtccttcccccgtcggcccaccccgtcctacccgaacgacgccacccgtccgtcgggggaccacgacgccgggcccgttcggggccgtcggcccgtcggggttaccgaaacggggtacccttaaccgtcccgttacgaacgttccggtccgttcgtcggacggccggggcgtacgggg

SEQ ID NO: 356070 - DNA, 533 bp, Homo sapiens
  misc_feature: GZ8MTXP02FFW8Y.45.78.H01.1.454.CMB.2.raw
  modified_base (286)..(286): a, c, t, g, unknown or other
  misc_feature (286)..(286): n is a, c, g, or t
  modified_base (491)..(491): a, c, t, g, unknown or other
  misc_feature (491)..(491): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggctctggatacaccttcaccggctactatatacactgggtncgacacggcccctggacaagggtctggagtggatggggatggatccaaccctaacaagtggtaggacaacaaactatgacacagagttcagggcagggtcacatagacagggacaccgcatcagcacagcctacatggagcgtagacgcgacggcgtagaggactcgacgaaacggaccgacgggtccgtaggtacttacgtggngacggaaggaggacgacggtaagttacgttagtttaggtagg

SEQ ID NO: 356071 - DNA, 580 bp, Homo sapiens
  misc_feature: GZ8MTXP02JRZJI.45.78.H01.1.454.CMB.2.raw
  modified_base (342)..(342): a, c, t, g, unknown or other
  misc_feature (342)..(342): n is a, c, g, or t
  modified_base (356)..(356): a, c, t, g, unknown or other
  misc_feature (356)..(356): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtattagtaactggttggcctggtatcagcaagaaaccagggaaacgcccctaaaggcctcctgctctataaggcatctagttagaaagtggggtcccatcaggtcagccggnagtgatcgtggganagaatcactctcacatcagcagcctgcagcctagatgtattttcgacttaaactttattaactcgaccaaacgtagtaatagaatttaggtttaacttcggtaccggtttcgggaaccgtaaacggggtaaccgtaaaggggtaggaaaacttacgaaaacggtaccgtaggtacggacgttaacggaccaaccgtactcttacggttacccttagttaacccg

SEQ ID NO: 356072 - DNA, 660 bp, Homo sapiens
  misc_feature: GZ8MTXP02HY5Z4.45.78.H01.1.454.CMB.2.raw
  modified_base (252)..(252): a, c, t, g, unknown or other
  misc_feature (252)..(252): n is a, c, g, or t
  modified_base (288)..(288): a, c, t, g, unknown or other
  misc_feature (288)..(288): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctccgtgcaaggcttcnggatacaccttcaccggctactatatacactgggtncgacacggcccctggacaaggctgagtggagtgggatggatcaaaccctaacagtggtaggacaacaaaactatggacaacgaacgtaagttttacgacggggacaacgggggttaccaacccgtaaagtcgaacccggaaacgggggtaacccgaaacccgggttacccaagttacccgtaagggacccaaaccgacggaccccttaaacccgaacggtttagggaacggtccgttagggaacgggacccgtaaagggcccggttaggaacggaagtaccgttacggaaccggtacgaaccgggtaccgtagttaaccgttacgtaggtcgcggaagacgacgaggtaattaacggttagttttaggtagg

SEQ ID NO: 356073 - DNA, 602 bp, Homo sapiens
  misc_feature: GZ8MTXP02HLBGX.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcagctgagatctgacgacacggccgtagtattacgtgtgcgagaggcgaggtattacgtagtttttggagttggttagttcggacggttagtggacgtcgtcgggaccgaacgggaccgacgtcaccgttctaccctcacgccctacccaccgaacggcccacgtccgtccctccccgtgcccacccctctaccaagacgccaccgtcggtcggggcacgcggcccggccgtcgggtctccggccttacggaccgtaaacgtccgttaacccgttccgttccggaacttcccggtcgttccgtggaccggcggggttccgcgggg

SEQ ID NO: 356074 - DNA, 585 bp, Homo sapiens
  misc_feature: GZ8MTXP02JH6IB.45.78.H01.1.454.CMB.2.raw
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
  modified_base (357)..(357): a, c, t, g, unknown or other
  misc_feature (357)..(357): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagagccgtggggcctnagtgaggtctctgcagctcnggatacacctcaccggctactatatacacgtgggtgcgacacggcccctggacaagggcttggagtggagtgggatggactacaacctaacagtggtagacaacaaactntgacaacaggtaagttcgaggggcaggtacacagtacgacgacggacgacgtaccactacacgacacacgactacagtagagacgtagacgacgacggacgtcgagacgtacgacgacggacgaccggtaccggtacgttacgttacgtacggacggttttttttacggaacggtaggacggtaacgggtaacggtttaacggtttaacggttttacggtttaagggg

SEQ ID NO: 356075 - DNA, 516 bp, Homo sapiens
  misc_feature: GZ8MTXP02F1UXD.45.78.H01.1.454.CMB.2.raw
  modified_base (425)..(425): a, c, t, g, unknown or other
  misc_feature (425)..(425): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggctctggatacaccttcaccggctactactatacactgggtgcgacaggcccctggacaagggcttgagtggatggggatggatcaacctacagtgtggacacaaactatgcacagaagtttcagggcagggtcacatgaccaggacacgtccagtcacgacacagacctacgatggganactagacgcgaggcgtagagatcagacgacacgggtcgtagtacttacgtcgtgcggaagacgacgaggtattacggtagttttaggtagg

SEQ ID NO: 356076 - DNA, 564 bp, Homo sapiens
  misc_feature: GZ8MTXP02GAE65.45.78.H01.1.454.CMB.2.raw
  modified_base (283)..(283): a, c, t, g, unknown or other
  misc_feature (283)..(283): n is a, c, g, or t
  modified_base (288)..(288): a, c, t, g, unknown or other
  misc_feature (288)..(288): n is a, c, g, or t
  modified_base (310)..(310): a, c, t, g, unknown or other
  misc_feature (310)..(310): n is a, c, g, or t
  modified_base (406)..(406): a, c, t, g, unknown or other
  misc_feature (406)..(406): n is a, c, g, or t
tcagacgcgatcgacacgaccggtgctcgatttagtgtgagtagtttgggtttgggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagcgngaganctgacgcacggccgtgattacngtgcgagaggcgagaatagtattttggtagtggttattcggtacggtatggacgtcgtggggccgaagggacgacggtcaccgtctcctcagcccncgacgaccgacggccacgtccgtccgttccccgtccgccgaccctccctaccgaacgacgccgaccgtccggtcgggacgacgcgccggccgtcggtcgtcgccgtcgtacgtacgtacgtaccgttccgtcgtacgtcgtcgtcgtcgacggcggcg

SEQ ID NO: 356077 - DNA, 624 bp, Homo sapiens
  misc_feature: GZ8MTXP02IFVNT.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagcctggggcctcagtgaaggtctcgtgcaaggcttcgtggatacaccttcaccggctactatatacacgtggtgcgacacggcccctaggacgaagggcttggagttgggagtgggataggaataccgaaaaccctaaacgaagtcgggtacggaccaaacgtaaaaccttagtcgaactaaacgagtaaacgtttacgacggggactacggggtacaaccgaagtacggaacccgagggaaccgtaccggtaccagtacgacgaccaacgacgaccctacagtaggacgccgtaggacgacgaggacgtagaagctacgacgacggacgacgggtaccgttagttaacgtacgtaggtacgacggaagacggacgtaggtaacgtttacggttagttttagggtagg

SEQ ID NO: 356078 - DNA, 601 bp, Homo sapiens
  misc_feature: GZ8MTXP02FHLZK.45.78.H01.1.454.CMB.2.raw
  modified_base (281)..(281): a, c, t, g, unknown or other
  misc_feature (281)..(281): n is a, c, g, or t
  modified_base (311)..(311): a, c, t, g, unknown or other
  misc_feature (311)..(311): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtgcacaaactatgcacagaagtttcagggcagggtcaccatgaccagggacacgtccatcagcacagcctacatggagctgagcgagngtgagatcagacgacacggcgtgtattacngtgcgagaggcaggtaattacgatttttggagtggttacttcggacgtatcggacgtcgtgggggccaagggccacgggtcaccgtctccctcacgccctaccgaccaacggggccccaagtcccgggtccctttccccccgtcggccctaacccccgttccctaccccaagaacggcctacccccgtccggtcggggacgacgacgccggcccgtcggcgtcgccgtcggtacgtaacggtaccgttaccttccgtaccgtcgtcgtcgtcgtcggacggcggcgtcgg

SEQ ID NO: 356079 - DNA, 502 bp, Homo sapiens
  misc_feature: GZ8MTXP02GL521.45.78.H01.1.454.CMB.2.raw
  modified_base (417)..(417): a, c, t, g, unknown or other
  misc_feature (417)..(417): n is a, c, g, or t
  modified_base (424)..(424): a, c, t, g, unknown or other
  misc_feature (424)..(424): n is a, c, g, or t
  modified_base (446)..(446): a, c, t, g, unknown or other
  misc_feature (446)..(446): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctgggggctgaggtgaagaagcctgggggcctcagtgaaggtctcctgcaaggcttctggatacaccttcaccggctactatatacactgggtgcgacaggcccctggacaagggcttgagtggatggggatggatcaacctaacaatggtgacacaaactatgcacagaagtttcagggcagggtcacatgacgaggacacgtccatcagcacacgcctanactggancgtagagcgaggctagagtacnctgacgacacacgccgagtactactgtgcgagaggcaaggactacgtattttaggg

SEQ ID NO: 356080 - DNA, 557 bp, Homo sapiens
  misc_feature: GZ8MTXP02JSW2I.45.78.H01.1.454.CMB.2.raw
  modified_base (251)..(251): a, c, t, g, unknown or other
  misc_feature (251)..(251): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaggcttcgnggatacaccttcaccggctactatatacacgtgggtcgacgacacggcccctggacaaggggcttggagtggagtgggatggatccaacctaaccaagtggtgacacaaactatgcacagaagtttcgagggcagggtcaccgaagtcgaacgagggacacgtccaatcgagcacagcctaacgagtcggagctaggagcgagggctggacgatcagacgacaccgggtccgtagttacgttacgtgttacggaccggtaaggacggtacggtaaggtaacttaccggttagttttagggtaacgg

SEQ ID NO: 356081 - DNA, 722 bp, Homo sapiens
  misc_feature: GZ8MTXP02HT4CC.45.78.H01.1.454.CMB.2.raw
  modified_base (250)..(250): a, c, t, g, unknown or other
  misc_feature (250)..(250): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggataggaaacnctcacttagaattggttacaacagacggccaggaccaatcctaccgaaggccgtaccttaaattttagtaaacggtttacgtaaccgggtactcgtacggggtacccaagacaaggattcgaaggccggacgaggttcgggtcgacgggctaccgtagtattttacgaactacgttaagtaaaaacgtttagggtagggggttaggaggtacgtaggtaagggtagttagggtttagggtttaacgtttttaagttttcgtagtacgtaagttacggaacgttaaacgggtaacctaacgttaacggttacggtacccggttaacgttaccgttttcgggacggtaacgggggaacctaaacggtacgttaaacggaaaacttaaacgaaaaaccggttacgttacgggtacgacgttacgacctaacctaagttcttaggttaccttacaccgtttcctccccgtactacg

SEQ ID NO: 356082 - DNA, 593 bp, Homo sapiens
  misc_feature: GZ8MTXP02G0CW8.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctcctgcaggcttctggatacaccttcaccggctactatatacacgtgggtgcgacacggcccctaggacgaaggcttggagtggagtgggatggactaccaacctaacagtggtagacaacaaactatgacaacgagtaaagtttcgaagggcacggggtcaccgagtacgaccgtaagggaccacgtccaagtacagaccaacgacgacctaacgagtacgggacgcgtagacgacggaggtctaggaagtactacgtacggaaccggacgaaccgggtccgttaagttacgttaacgtcggtagacggaaggacggacgtaaggtaacgtttacggttagttttaggtaaggg

SEQ ID NO: 356083 - DNA, 582 bp, Homo sapiens
  misc_feature: GZ8MTXP02JC0A5.45.78.H01.1.454.CMB.2.raw
  modified_base (249)..(249): a, c, t, g, unknown or other
  misc_feature (249)..(249): n is a, c, g, or t
  modified_base (269)..(269): a, c, t, g, unknown or other
  misc_feature (269)..(269): n is a, c, g, or t
  modified_base (364)..(364): a, c, t, g, unknown or other
  misc_feature (364)..(364): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacnctcacttgaattggttcaanagaggccaggccaatctccaaggcgacctaaatttataaggttctaaccggactcgtggggtcccagacagatcagcgcagtggtcaggcactgntttcactactagtaaaattaggtagggtggaggcgtaggaagggtatggtttggtagttttattcgtgtactatgacgtaaaggtacactacgtcggaccgttactaaccgttttcggaccgtagggggtaaccaagtccgtaggaaaactaccgaaaacggaactaggaggtactgaccgaccgtaatcgtgtccttcactttccctcccgtactac

SEQ ID NO: 356084 - DNA, 593 bp, Homo sapiens
  misc_feature: GZ8MTXP02HQPGW.45.78.H01.1.454.CMB.2.raw
  modified_base (250)..(250): a, c, t, g, unknown or other
  misc_feature (250)..(250): n is a, c, g, or t
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagaagccgtggggcctcgagtgaggtctctgcgaggtcttnggatacaccttcacgctactatatacagtggtgccgacacggcccctaggacgaaggtcttaggaggtaggtagtgggagtaggactaccaaacctaaccgtaaagtcggtagacctaactaaacgtagtcgaccaacgtaaggttaacgtttacggaaggggactagggtaccaacgtacgacgaaccgaggaacctacgtacacgacgacgacacacgtacctaacgagtacggagcgagacgacgacggcgtagagtacgtgacgacgacgtacggacgttagtacgtacgtaggtcgacggtaagacgagtaaggtacgtttagtaggttttggtaagg

SEQ ID NO: 356085 - DNA, 542 bp, Homo sapiens
  misc_feature: GZ8MTXP02IHRND.45.78.H01.1.454.CMB.2.raw
  modified_base (426)..(426): a, c, t, g, unknown or other
  misc_feature (426)..(426): n is a, c, g, or t
  modified_base (435)..(435): a, c, t, g, unknown or other
  misc_feature (435)..(435): n is a, c, g, or t
  modified_base (461)..(461): a, c, t, g, unknown or other
  misc_feature (461)..(461): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagcctggggcctcagtgaggtctcctgcaaggcttctggatacaccttcaccggctactatatacactggtgcgacacggcccctggacaagggcttggagtggagtgggatggatacaacctaacaagtggtagacaacaaactatcgacaacgaagtaagtttcgaggggcaggggtccacgatacgacgagggacacgtccatcagcanacgcctaangtagagctagagacgagcgtagagancgtagacggacgacggtccgtagtaacgttcgtagtgacgaagacggacgaaggttaacttacggttagttttaggtaagg

SEQ ID NO: 356086 - DNA, 526 bp, Homo sapiens
  misc_feature: GZ8MTXP02ICP2S.45.78.H01.1.454.CMB.2.raw
  modified_base (251)..(251): a, c, t, g, unknown or other
  misc_feature (251)..(251): n is a, c, g, or t
  modified_base (362)..(362): a, c, t, g, unknown or other
  misc_feature (362)..(362): n is a, c, g, or t
  modified_base (392)..(392): a, c, t, g, unknown or other
  misc_feature (392)..(392): n is a, c, g, or t
  modified_base (410)..(410): a, c, t, g, unknown or other
  misc_feature (410)..(410): n is a, c, g, or t
  modified_base (432)..(432): a, c, t, g, unknown or other
  misc_feature (432)..(432): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagagccgtgggcctcagtgaggtctcctgcaaggcttcnggatacaccttcaccgctactatatacacgtggtcgcgacacggcccctggacgaagggcttaggagtggagtggatggactcaacctaccaagtggtgacaacaaacttncacacgagtagtacgaggacgacgacacanacgacgacgacacgacanacacgacacgacacagagtagntacgagcgacgagcgagagtagcgacgacgacgacgtacgtagtactacgtcgtagacggaagacgacgtacgtagttacgttagtttaggtag

SEQ ID NO: 356087 - DNA, 641 bp, Homo sapiens
  misc_feature: GZ8MTXP02I2CTC.45.78.H01.1.454.CMB.2.raw
  modified_base (363)..(363): a, c, t, g, unknown or other
  misc_feature (363)..(363): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtatactgtgcgagaggcaggaattacgtatttttggagttggttattcggacggttntgggacgtcgtgggggaccgaaggggacccgacggtccaccgtctcccgtcgacgccctaccgaccgaacggggccctacgtccgggttccctttcccccgtcggacccctaccccgttaccctaccgaaccgacgtcccacccgttccggcgggggcaaccggacggccgggtccccgtcggggccttccggcccgttacgggtaccgaaaccgggtaccttaccttcccgtacggtaacgtcccgtcgttcccggtacggaccggtcggcgtcggg

SEQ ID NO: 356088 - DNA, 657 bp, Homo sapiens
  misc_feature: GZ8MTXP02GJ4LS.45.78.H01.1.454.CMB.2.raw
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacactcacttgaattggttacaacagagccaggccaatctaccaaggcgaccttaaatttagtaacggtttacgtaaccggactcgtcggggtacccagaccagtattcgagcggaccaggtgggtcagggcacgttgatttcacactagaaaattggtaggggtggagcgtaggaggtagtggttaggtaagttttatttacgtgtacagtgaacgtaaacggtacacgtaacgtcgggtacccgtacgttaccgttttacggaccggtaacgggggtaacctaaggacgttaacgggaaaactaaccgtaaaacggtaaacgtacggttaacgggccgttacggacccgtaaccctaagttccgttcgttaccgtttactaaccttcccctttaccccggtacctaccg

SEQ ID NO: 356089 - DNA, 541 bp, Homo sapiens
  misc_feature: GZ8MTXP02ILDWJ.45.78.H01.1.454.CMB.2.raw
  modified_base (245)..(245): a, c, t, g, unknown or other
  misc_feature (245)..(245): n is a, c, g, or t
  modified_base (251)..(251): a, c, t, g, unknown or other
  misc_feature (251)..(251): n is a, c, g, or t
  modified_base (349)..(349): a, c, t, g, unknown or other
  misc_feature (349)..(349): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctgagtgagtctctgcagctngatacnctcacgctacatatacacgtggtgcgacacggcccctggacgaaggcttggagtggagtgggatggactacgaaacctaacagtggtgacacaaactntgacacagtaagttccgaggggcacgggtacaaccgtagtacgacgagggaaccacgtccaatcgagaccaacacgaccctagagtacggagacgtagacgcgaggacgtgagtactgacgacgacgtcggccgttagtacttcgagtgacgaaggacggacgtaagggtacttaggttagtttagggtagg

SEQ ID NO: 356090 - DNA, 518 bp, Homo sapiens
  misc_feature: GZ8MTXP02G6DEO.45.78.H01.1.454.CMB.2.raw
  modified_base (429)..(429): a, c, t, g, unknown or other
  misc_feature (429)..(429): n is a, c, g, or t
  modified_base (442)..(442): a, c, t, g, unknown or other
  misc_feature (442)..(442): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctctgcaggctctggatacacttcacgctactatatacactggtgcgacacggcccctggacaaggcttgagtggatgggatggatacaacctaacaagtggtgacacaaactatgacaacagtaaacgtttcgaggggtcaggggtcacgatacgacgaggacacgtcatcgagacacagacctacaatcggancgtagagcgaggnagagactcgaggacgacgacgtccgagtacttacgacgtagcgaagcggacgaggtaacttacgtagtttagtagg

SEQ ID NO: 356091 - DNA, 562 bp, Homo sapiens
  misc_feature: GZ8MTXP02GVT91.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgaggtgaaggtctccgtgacaaggtcttcgtggatacaccttcgaccggctactatatacacgtggtgcgacacggcccctggacgaagggcttaggagtgggagtggggatggactaccgaaaccctaacgagtggtacgacaacaaactatgacaacgagtagttcgaggcagggtcacgatcgacgaggacacgtacatacagacaacgacgacctacgagtggactcgagacgcgaggctaggagacgtcgacggaacgacgacggtccgttagtacttacgcgtagacggaagacggagtaaggtattacggttagtttaggtaaggg

SEQ ID NO: 356092 - DNA, 628 bp, Homo sapiens
  misc_feature: GZ8MTXP02JE6IR.45.78.H01.1.454.CMB.2.raw
  modified_base (343)..(343): a, c, t, g, unknown or other
  misc_feature (343)..(343): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtggaaggtctcctgcaaggtcttctggataccacccttcaccggctactatatacacgtggtgcgacacggcccctggacaagggcttgagtggatgggatggatacaaaccctaaanagtggtcggaccaacgtaaactatgacaacgaagtacgttacgacgggtcgagggtaccaaccgagtcggaaccgacggacaccgtcgatacgagaccacgacgaccctagagtaggaacgcgaggagaccgagggactaggacgtagtcgtacggaaccggacgacgggtccgttagttagttacgttcggacgacgggtacggagggactaaagggtaaacgtttacggttaaggtttttaggggaagttttaggggtttaccggtacggggtttaaacgggg

SEQ ID NO: 356093 - DNA, 577 bp, Homo sapiens
  misc_feature: GZ8MTXP02IUX0Z.45.78.H01.1.454.CMB.2.raw
  modified_base (284)..(284): a, c, t, g, unknown or other
  misc_feature (284)..(284): n is a, c, g, or t
  modified_base (289)..(289): a, c, t, g, unknown or other
  misc_feature (289)..(289): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagcgngaganctgacgacgacggccgtgtattactgtgcgagaggcaggaattacgtatttttggagttggttagttcggacggttatgggacgttcgtgggggaccaacggggccacgggtcgaccgtctccctcacgcctcccaccgacgggcccacgttccggtccttcccccgtcggccctacccctcctccaacgcgccacccgtcgtcggggcacgcgccgcccgcgggctcgcctggtaccgaacggtactaccgttcctcgcgtcgcgttcggtcggcggtcggtcgtcg

SEQ ID NO: 356094 - DNA, 560 bp, Homo sapiens
  misc_feature: GZ8MTXP02GCE9T.45.78.H01.1.454.CMB.2.raw
  modified_base (367)..(367): a, c, t, g, unknown or other
  misc_feature (367)..(367): n is a, c, g, or t
  modified_base (432)..(432): a, c, t, g, unknown or other
  misc_feature (432)..(432): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgcaaggcttctggatacaccttcaccggctactatatacactggtgcgacacggcccctggacaaggtcttgagtggatggggatggatacgaaacctaaccaagtggtaggacaacaaactntgcaacagtaagttcgaagggcagggtcacatcgaccagggacacgtccatcagcacagacctanacgtggactcgtagagcgaggtcgtacgacgtagtacgtacggaaccgacgaccgggtcgttacgtacgttaccgtggtagcggaagaaggacgaaggtaacgttacggttaggttttaggttaaggg

SEQ ID NO: 356095 - DNA, 648 bp, Homo sapiens
  misc_feature: GZ8MTXP02HEJO3.45.78.H01.1.454.CMB.2.raw
  modified_base (287)..(287): a, c, t, g, unknown or other
  misc_feature (287)..(287): n is a, c, g, or t
  modified_base (311)..(311): a, c, t, g, unknown or other
  misc_feature (311)..(311): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcggggcagggtcaccatgaccagggacacgtccatcagcacagccctacatggagctgagcaggctganatctgacgacacggctgtattacngtgcgagaggcaggtaattacgtagttttaggagtggtttatcgggtacggtattgggacgtcgtgggggaccaaacggggcccaacgggtccaacccggttcctcccttccgacgtccccgtacccaacccgaacggggcccctaacgtccgggttaccccttcccccgtcggcccaacccccgttcctaccgaacgacgcctaccgtcgtcggggcacgacggccggcccgtggggcctcggcccgtagggtaccgaaacgggtaccttaccgtttacccgtcggaaccttccggtccgtttaccgtcggacgggtccgggaccgttggaaccgg

SEQ ID NO: 356096 - DNA, 625 bp, Homo sapiens
  misc_feature: GZ8MTXP02G02T8.45.78.H01.1.454.CMB.2.raw
  modified_base (243)..(243): a, c, t, g, unknown or other
  misc_feature (243)..(243): n is a, c, g, or t
  modified_base (265)..(265): a, c, t, g, unknown or other
  misc_feature (265)..(265): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagagccgtgggcctgagtgagtctctgcagctngatacaccttcaccgctactanatacacgtggtcgcgacacggccccgtaggacgaagggtctggaggtgggagtgggagtggactaccgtaaacctaaccgaagtggtacggacaaactaaacgttatcgacaacgtaagtaagtttcgaggggcgacggggtaccacgatacggaccgaacgggacaccgtaccagtaccgagaccaaccgacgacccgtaacacggttacggacggtcgaggaacgcgacgggtacgtaggacgtaacgtcgtaacggaccggtaacggtaccggtcggtttaacgttacgttaacgtggtacggacgaagggacggaacggtaaggttaacgtttacggtttaggttttaggtaaggg

SEQ ID NO: 356097 - DNA, 582 bp, Homo sapiens
  misc_feature: GZ8MTXP02J3LMK.45.78.H01.1.454.CMB.2.raw
  modified_base (287)..(287): a, c, t, g, unknown or other
  misc_feature (287)..(287): n is a, c, g, or t
  modified_base (315)..(315): a, c, t, g, unknown or other
  misc_feature (315)..(315): n is a, c, g, or t
  modified_base (473)..(473): a, c, t, g, unknown or other
  misc_feature (473)..(473): n is a, c, g, or t
  modified_base (506)..(506): a, c, t, g, unknown or other
  misc_feature (506)..(506): n is a, c, g, or t
  modified_base (530)..(530): a, c, t, g, unknown or other
  misc_feature (530)..(530): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatggagctgagcgaggctgagntctgacgacacggtctagtactacgtgngcgagaggcaaggtacttacgtagttttggagttggttaattcgggacggttagtcggggacgttcggcggggaccgaacgggaccctacgggtccaacccgttcctccctcgaacgccctacccaccggacggccctagtcccgggtccttccccgngtcccaccctccgtacaacgcgccaccgtcggngggaccacgcgccgcccgtggccncgcgcgacacgtcctaccttcgacgtcgtcgcgtcgacggcggtcggcgcgg

SEQ ID NO: 356098 - DNA, 639 bp, Homo sapiens
  misc_feature: GZ8MTXP02H8FIB.45.78.H01.1.454.CMB.2.raw
tcagacgcgatcgacacgaccggtgctcgatttagtgtgagtagtttgggtttggggacccagcaaccacatctgtcctctagacaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctctgcaaggcttctggatacaccttcaccggctactatatacacgtggtcgcgacacggcccctaggacaagggcttggagtggatgggatggatcgaaacctaacgaagtggtggaccaacaaaactatgacacaagtagtttccgaaggacgtagggtaccaccgatacgaacccgaaggacgtacgtacctaacgcaacggcaaaccgacgcctaactagaggagtaccgtaggacgacgacgggacgtagaagtacttcgtacggaacgacgtaccggggtaccttaggtaacgttttcgtagtacggacgtaaggggacggacggtaaagggtaaacgtttacggttaaggttttttacgggaacggttttacggggtttaagtttacccgggggtaaacgggg

SEQ ID NO: 356099 - DNA, 559 bp, Homo sapiens
  misc_feature: GZ8MTXP02HTNFU.45.78.H01.1.454.CMB.2.raw
  modified_base (228)..(228): a, c, t, g, unknown or other
  misc_feature (228)..(228): n is a, c, g, or t
  modified_base (250)..(250): a, c, t, g, unknown or other
  misc_feature (250)..(250): n is a, c, g, or t
  modified_base (349)..(349): a, c, t, g, unknown or other
  misc_feature (349)..(349): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctggaggtgaagaagccgtggggcctnagtgaggtctctgcaggcttcnggatacaccttcgaccggctactatatacacgtgggtgcgacgacgggcccctggaaccgaagggcttggagtggagtgggatggactacaaacctaanaagtggtacggacaacaaaactatcgacaacgagtaagtttcgagggcgaagggtacaaccgatacgaaccgaggggaaccacgtccatcaacgcacacgcctaacagtggaagcgtagagacgaggcgtagagactcgagaccgacgacggtccgtagtacttacgtgcgacgaaggagacgaaggtaacttacgttagtttaggtagg

SEQ ID NO: 356100 - DNA, 692 bp, Homo sapiens
  misc_feature: GZ8MTXP02HRI37.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtcatcagcacagcctacatggagctgagcaggctgagatctgacgacacggccgtgtatactggtgcgagaggcgaggacttagtagtttttggagttggttagttcggacggttatgggtacgttcgtgggggaccgtaaagggggaccctaacgggtccgaacccgtctccctcgacgccctcccaaccgaacgggcccaagtccggtcccttcccccgtggcccctaccccgttccctaccgaaacgccggtacccctacccgttccgggtacgggggaccaaccgacgggtcccgccccggttcggggcccgtaaccggtccccggtttaagggacccggtaaaacggggtaacccgtttaccctttaccccgttcggaaccggtttaccggacccggtttcccgggtacggggtaccggggtccggggtaccggtcggg

SEQ ID NO: 356101 - DNA, 538 bp, Homo sapiens
  misc_feature: GZ8MTXP02FPKJ2.45.78.H01.1.454.CMB.2.raw
  modified_base (438)..(438): a, c, t, g, unknown or other
  misc_feature (438)..(438): n is a, c, g, or t
  modified_base (508)..(508): a, c, t, g, unknown or other
  misc_feature (508)..(508): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccggctactatatacactgggtgcgacaggcccctggacaagggcttgagtggagtgggatggatacgaaaccctaacaagtggtggacaacgaaaacctatgacaacgaagtaaagtttcgaaggggcagggtacacagtgacgagggacacgtccatcagcacagccctanagtggagacgtgagcgaggctagagatacgagaacgacgacggccgtagttacttacgtgtgacgaaggnggacgaggtaagttacgtagtttggtaagg

SEQ ID NO: 356102 - DNA, 571 bp, Homo sapiens
  misc_feature: GZ8MTXP02HWELP.45.78.H01.1.454.CMB.2.raw
  modified_base (227)..(227): a, c, t, g, unknown or other
  misc_feature (227)..(227): n is a, c, g, or t
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccgaggtgcagctggtgcagtcgtgggctggaggtgaagagccgtgggctnagtgagtctctgcagcttngatacncctcacgctactatatacacgtgggtgcgacacggcccctaggaacgaagggcttggaggtggagtgggatggactacaaaccctaanaagtggtacgacaanaaactatgacaacgaagtaagtttacgagggacgacgggtacaccagtacgaccgaagggaccacgtacccataccgagacacgacgcctaacgagtggaccgagtaggaacgcggaaggtcgtaggaagtagtcgacgaacggacgtacggtccgtagttacttagtcggagacgaaggagacgtaggtaacgtttacgttaggttttaggtagg

SEQ ID NO: 356103 - DNA, 580 bp, Homo sapiens
  misc_feature: GZ8MTXP02JBRQE.45.78.H01.1.454.CMB.2.raw
  modified_base (227)..(227): a, c, t, g, unknown or other
  misc_feature (227)..(227): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (280)..(280): a, c, t, g, unknown or other
  misc_feature (280)..(280): n is a, c, g, or t
  modified_base (285)..(285): a, c, t, g, unknown or other
  misc_feature (285)..(285): n is a, c, g, or t
  modified_base (362)..(362): a, c, t, g, unknown or other
  misc_feature (362)..(362): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtgggcctnagtgaggtctctgcaggctnggatacnctcaccgctactatatacacgtggtncgacncggcccctggacgaggcttggagtgggagtgggatggactaccgaaccctaacgagtggtacgaacaactaaacgtntcgacaacggtaagtaacgttcgagggtcgacgggtaccacgtagacgaccggacggaacacgtcatcgacgacacgacgacctagacgtagacgtcgagacgacgaggtcgtagacgtagtacgcgaacggacgtacgggtccgttagttacgtacgtcggacgagggaagcggtaacgtaaagggtaactttacggttaggttttacggtaagggg

SEQ ID NO: 356104 - DNA, 581 bp, Homo sapiens
  misc_feature: GZ8MTXP02HXCZ7.45.78.H01.1.454.CMB.2.raw
  modified_base (289)..(289): a, c, t, g, unknown or other
  misc_feature (289)..(289): n is a, c, g, or t
  modified_base (318)..(318): a, c, t, g, unknown or other
  misc_feature (318)..(318): n is a, c, g, or t
  modified_base (455)..(455): a, c, t, g, unknown or other
  misc_feature (455)..(455): n is a, c, g, or t
  modified_base (477)..(477): a, c, t, g, unknown or other
  misc_feature (477)..(477): n is a, c, g, or t
  modified_base (568)..(568): a, c, t, g, unknown or other
  misc_feature (568)..(568): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgctacaggcccctggacaagggcttgagtggatgggatggatcaacctaacaatggtggcacaaactatgcacagaagtttcagggcagggtcaccatgaccagggacacgtccatcagcacagcctacatggagctgagcaggctgagatcngacgcacggccgtgtattactgtgcgagnggacgaggtaattacgtatttttgggagttggttaagttcggtacggtatgggtacgtcgtgggggacccgaaagggtaccgacgggtccaccgtctccgtcacgcctaccgacacgggccacgtcgtccttcccgngccgtcctcgactcgacggacncgaccgtcggtcggggcaacgcggtccggcccgttcgggacttcggccgtggtaccaaacggccttaacgtccgtcgactccggcgttacncggacgtcggtcg

SEQ ID NO: 356105 - DNA, 548 bp, Homo sapiens
  misc_feature: GZ8MTXP02ITEQO.45.78.H01.1.454.CMB.2.raw
  modified_base (357)..(357): a, c, t, g, unknown or other
  misc_feature (357)..(357): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagcctggggcctcgagtgaaggtctcctgcaaggcttctggatacaccttcaccggctactatatacactggtgcgacaggcccctggacaagggctgagtggatgggatggatcaacctaaccaatggtgacaacaaactangacacagagtttcgaggcgaggcacatgacgaggacacgtccatcagcacagacctacagttaggagcgtagacgcgaaggcgtaggagtacgtcgtacgacgaccgaccgggtccgtacgttacttaccgtggtacgacggaaggtacggacgtaacggtaaacgtttacggttagttttagggttaggg

SEQ ID NO: 356106 - DNA, 679 bp, Homo sapiens
  misc_feature: GZ8MTXP02HQEZP.45.78.H01.1.454.CMB.2.raw
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtagaagagccgtgggcctnagtgagtctctgcaggcttcnggatacacctcaccgctactatatacacgtgggtgcgacgacggccccgtggaacgaaggcttaggagtgggagtgggagtgggaactacctaaaacccgtaaagaaacgttgggtacggacaaactaaaactatcggacaacgtaagtaaacgtttacgaacggggacgtaacggggtaccaaaccgtaagtacgaaccggaacgggaaccgaccggtaccaactacgaacgaccaaacgtacgaccctaacgagttaggacgacgtagacgacgtaggactaggaagtacgtacgtaacggaccggtaaccggaccgggtaccgttaggtttaaacgttaccgtcggttacggaacggtaaacgggacgggaaacggtaaacgggttaaaacggttttacggtttaaggttttttagggttaaccgggg

SEQ ID NO: 356107 - DNA, 699 bp, Homo sapiens
  misc_feature: GZ8MTXP02GZBEK.45.78.H01.1.454.CMB.2.raw
  modified_base (290)..(290): a, c, t, g, unknown or other
  misc_feature (290)..(290): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagaagtttcagggcagggtcaccatgaccaggacacgtccatcagcacagcctacatggagctgagcaggctgagatcngacgacgacggccgtagtattacgtgtgcgaggaggacgaaggtaaagtttacgttagtttttagggaggtttaggtttaagttacgggtacggttagtcggggtacggttcgggtacgggggacccgaaacgggggaccgtaccggggtccaacccgttctccccgtacgaccggtcccctacccgaacccgaaccggggcccctaacgttcccgggttcccccttcccccgtcggacccctacccccgttcccgaaccgacgacccgaccctaccgtcgggacgggacaccggcggccccgggtcgtcgggtccgtaccggtccggtacggtaaccgtaaccggttaccttacccgttccgtacgtaaccgtccgtacgttcggacggtccgggcggcggtaccggg

SEQ ID NO: 356108 - DNA, 572 bp, Homo sapiens
  misc_feature: GZ8MTXP02IK6GX.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtagaagaacgccgtgggcctgagtgaggtctcgtgcgaaggcttgtgatacaccttcgaccgctactatatacacgtggtgacgacgacggcccctggaacgaggtcttaggagtggagtgggagtgactacgaacctaagaagtggagacaactaaactatcgacaacgagtaacgttcgaggtacgaggtacacgagtacgacgaggacacgtaccatacgacgacacgacgtacctacgacgtaggagcgtagacgacgagacgtagagtacgtcgtacgaacggcgtacggcgttagtacgtacgtacgtgacggaaggtacggacgtaggtaacgttaggtttacggtttaggttaagg

SEQ ID NO: 356109 - DNA, 565 bp, Homo sapiens
  misc_feature: GZ8MTXP02GA23D.45.78.H01.1.454.CMB.2.raw
  modified_base (252)..(252): a, c, t, g, unknown or other
  misc_feature (252)..(252): n is a, c, g, or t
  modified_base (355)..(355): a, c, t, g, unknown or other
  misc_feature (355)..(355): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (434)..(434): a, c, t, g, unknown or other
  misc_feature (434)..(434): n is a, c, g, or t
  modified_base (442)..(442): a, c, t, g, unknown or other
  misc_feature (442)..(442): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttcnggatacaccttcaccggctactatatacacgtgggtgcgacacggcccctggacgaagggcttggaggtggatggggatggactacaaacctaaccaagtggngacacaaactntgacanagtaagttcgagggcagggtcacagtgaccgagggacacgtccatcagacacgagccctaanagtggacncgagacgacgaggtcgagagtacgtcgacggacgaccggtacggtacgttagttacgttacgtcggtacggacggaaggtacggacgtaacggttaacgtttacggttaggttttacggtagg

SEQ ID NO: 356110 - DNA, 587 bp, Homo sapiens
  misc_feature: GZ8MTXP02G8O86.45.78.H01.1.454.CMB.2.raw
  modified_base (218)..(218): a, c, t, g, unknown or other
  misc_feature (218)..(218): n is a, c, g, or t
  modified_base (227)..(227): a, c, t, g, unknown or other
  misc_feature (227)..(227): n is a, c, g, or t
  modified_base (237)..(237): a, c, t, g, unknown or other
  misc_feature (237)..(237): n is a, c, g, or t
  modified_base (418)..(418): a, c, t, g, unknown or other
  misc_feature (418)..(418): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggacgcccactcccaggtgcagctggtgcagtcgtgggctggaggtgaagagcgtgggctnagtgagtcnctgcagtctngatacacttcgaccgtctatatatacagtggtgcgacgacggccccgtaggacgagggtctggaggtaggagtgggataggactaccgaaaccctaaagagtggtagacccaaacgtaactagagacaagaagttaggttcgagggacgacggtaccacgagtacgacgagaccacgctanacgacgccaacgaccgactacgagtacggacgtacgaggacgcgaggtacgagacgtacgtacgacggaacgaccggtacggtaccgttagttacgtagtcggtagacggagacgaagtaaggtaacgttaggttagtttagggagtttacggttacggtacggtaagg

SEQ ID NO: 356111 - DNA, 710 bp, Homo sapiens
  misc_feature: GZ8MTXP02JNNPL.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacagtggagctgagcgaggctggagatcacgacgacgacggccgttgtattacgtggtcggacgaggtaggactaaggggtaactttacggtagtttttaggggagtttacgggtttagtcggggtaacggttagtggggtaccgttcggtacgggggaccgaagggggtacccgtaaccgggtaccgacccgttccttacccgtacgaaccggtcccctaacccgaaaccccggaaccggtccccgtaacggtcccgggtttaccccttcccccggttacggccccctaaccccggttcccctaaccgaacgaccgtacctacccgttcgggcgggggaccacggcggcccgtccggtcggcgttccgcgtttcggacgtaacggtaccttaccgttacccgcgtaacgtccggtccgttacgacggtacggcgggtctacgggg

SEQ ID NO: 356112 - DNA, 573 bp, Homo sapiens
  misc_feature: GZ8MTXP02I4M7B.45.78.H01.1.454.CMB.2.raw
  modified_base (252)..(252): a, c, t, g, unknown or other
  misc_feature (252)..(252): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctctgcaggcttcnggatacaccttcaccgctactatatacacgtggtgcgacacggcccctggacgaaggtcttggaggtgggagtgggatggactaccaaacctaacgaagtgggtgacaacaaacgtatcgacaacgaagtaacgtttcgaacggggcgacggggtacaccgagtacgaaccgagggacacgtccactcgagacacacgacctacagtaggacgcgtagacgacgaggcgtaggagtactcgacgaccggacgaccggtacgttagtaattcgtggtcgacggaaggaggtacgaggtaatttacggttaggtttaggtagg

SEQ ID NO: 356113 - DNA, 554 bp, Homo sapiens
  misc_feature: GZ8MTXP02F8W4U.45.78.H01.1.454.CMB.2.raw
  modified_base (414)..(414): a, c, t, g, unknown or other
  misc_feature (414)..(414): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctggacaagggtcttaggagtggatggggatggatcaacctaacatggtagcaacaaactatgcacagaagttcgaggcagggtcacatagaccgaggacacgtcatacgagacanacgcctacagtagagctagacgcgaggcgtagacgagtcgtaggaacgacgaccggtaccgtagtacgttaaccgtggtacgaccggtaaggaggaccgtaagggtaaccgtttacggttaagtttttacgggtaaaggg

SEQ ID NO: 356114 - DNA, 625 bp, Homo sapiens
  misc_feature: GZ8MTXP02IWVGX.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaaattacgtagttttttgggagttgggtttagtttcgggaacggttatggggtaacgttcgttcgggggaccaagggggtaccacgggttcaccgtctccctcacgcctcccaccgacgggacccacgtccgggtcccttcccccgtcggccctacccctcccgtacccaacgcgccaacccgtcgtcgggggccaacgcggccggcccctgggggccttcggcccttgggtaccaacgggtacttaaccgttcccttacggcgttcggcgtttacccggtggacggtcgggtcgtcgg

SEQ ID NO: 356115 - DNA, 519 bp, Homo sapiens
  misc_feature: GZ8MTXP02HSHWI.45.78.H01.1.454.CMB.2.raw
  modified_base (260)..(260): a, c, t, g, unknown or other
  misc_feature (260)..(260): n is a, c, g, or t
  modified_base (342)..(342): a, c, t, g, unknown or other
  misc_feature (342)..(342): n is a, c, g, or t
  modified_base (420)..(420): a, c, t, g, unknown or other
  misc_feature (420)..(420): n is a, c, g, or t
  modified_base (445)..(445): a, c, t, g, unknown or other
  misc_feature (445)..(445): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (484)..(484): a, c, t, g, unknown or other
  misc_feature (484)..(484): n is a, c, g, or t
tcagacgcgatcgacacgaccggtgctcgatttagtgtgagtagtttgggtttgggggagcatcacccagcaaccacatctgtcctctagagaatccccctgagagctccgttcctcaccatggactggacctggaggatcctcttcttggtggcagcagccacaggagcccactcccaggtgcagctggtgtagtctggggctggaggtgaagaagcctggggcctcagtgaaggtctcctgcaaggcttctggatacnccttcaccggctactatatacacgtgggtgcgacaggcccctggaccaagggcttggagtggatgggatggatcaacctaanatggtgacacaaactatgcacagtaaagtttcgaagggtcaagggtcacatacggacagggcacgtccagtcagcacncgactacagtgagctgagcgagcgnganangagacgacgacgtcgtacgtacgtacgtcgtcgngagaaggagacgtagttagttagtttaggtaggtg

SEQ ID NO: 356116 - DNA, 651 bp, Homo sapiens
  misc_feature: GZ8MTXP02HZYX4.45.78.H01.1.454.CMB.2.raw
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (308)..(308): a, c, t, g, unknown or other
  misc_feature (308)..(308): n is a, c, g, or t
  modified_base (319)..(319): a, c, t, g, unknown or other
  misc_feature (319)..(319): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggccctggacaagggcttgagtggatgggatggatcaacctaacaatggtggcaacaaactatgcacagtaagtttcagggcagggtcaccatgacaggacacgtcatcagcacagcctacatggagcngagcgagcgngagntcagacgacacgcgtgtatacgngtgcgagaganaggtaataggtagttttggagttggttacttgggacgggttatcgggtacgttcggagggggaccgaaaggggacccacgggtaccgtaacccgtctacccgtcgaaccggtccctacccgaacccgtaacgggaccccctagttccccgggttcccttaccccccgtggaccccctaccccgtacccttacgaaaccggcgacccaccggttcggccgggggccaaacgccgggtccggccccggtggggcttccggcccgtggtaccggaacggaccgttacctaccgttcgaacgttccgacgttaccggtacggcggcggtacgtcgg

SEQ ID NO: 356117 - DNA, 675 bp, Homo sapiens
  misc_feature: GZ8MTXP02FMWVB.45.78.H01.1.454.CMB.2.raw
  modified_base (400)..(400): a, c, t, g, unknown or other
  misc_feature (400)..(400): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccgaggtgcagctggtgcagtcgtggggctggaggtagaagaacgccgtggggcctcgagtagaaggtctccgtgcgaaggtcttcgtaggataccaccttcgaccggtctactatatacacgtgggtcgccgacgacggtcccctaggaacgaagggtcttggagtgggagtgggatggactaccaaacctaagtaagtcggtagacctaaacgtaaaacttntcgaccaaacgtaaggttaaagtttccggaaaggggtcgtaacggggttacccaaccgtaacgtacggaaaccggaacggggtaaccctaaccggtaccaagtacccgaacggtaccaacgaaaccgtaccctaaacgaggtagggaacgtcgtaggaacgcgaaggtacgtagacgtaacgtcgacggaaccgacggaccggtacgttagtacgttacgtaggtcgacggaaggacggacgtaaaggtacgtttaacggtaggtttaggtaagg

SEQ ID NO: 356118 - DNA, 500 bp, Homo sapiens
  misc_feature: GZ8MTXP02HWSL7.45.78.H01.1.454.CMB.2.raw
  modified_base (435)..(435): a, c, t, g, unknown or other
  misc_feature (435)..(435): n is a, c, g, or t
  modified_base (444)..(444): a, c, t, g, unknown or other
  misc_feature (444)..(444): n is a, c, g, or t
  modified_base (479)..(479): a, c, t, g, unknown or other
  misc_feature (479)..(479): n is a, c, g, or t
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagctggggcctcagtgaaggtctctgcaaggcttctggatacaccttcacggctactatatacactgggtgcgacaggcccctggacaagggcttgagtggatgggatggatcaaccctaacaatggtgcacaaactatgcacagagtttacaggggcagggtcacatcgacgagggacacgtccatcagcacagcctacagtaggagctacgagcgaggacngaggatacnggacgacgacggccgtagattactgtgcgaagagngaggatacgtagttttgtagg

SEQ ID NO: 356119 - DNA, 514 bp, Homo sapiens
  misc_feature: GZ8MTXP02JL5FQ.45.78.H01.1.454.CMB.2.raw
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggtcttctggatacaccttcaccggctactatatacactggtgcgacaggcccctggacaaggctgagtggatgggatggatcaacctaacagtgtaggcacaaactatgacanagaagtttnagggtcagggtcacatagacgaggacacgtccatcacgacacacgcctagagtgagctagaacgcgagctgacgatcgtagacgacgacgaccgtagtacttacgtcgtgacgaaggagacgacgtattacgtagtttaggtaagg

SEQ ID NO: 356120 - DNA, 631 bp, Homo sapiens
  misc_feature: GZ8MTXP02JU7DI.45.78.H01.1.454.CMB.2.raw
  modified_base (371)..(371): a, c, t, g, unknown or other
  misc_feature (371)..(371): n is a, c, g, or t
  modified_base (428)..(428): a, c, t, g, unknown or other
  misc_feature (428)..(428): n is a, c, g, or t
  modified_base (584)..(584): a, c, t, g, unknown or other
  misc_feature (584)..(584): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggcgtgagatctgacgacgacggccgtgtatacgtgtgcgaggagcgaggaattacggatttttaggagttggttagttcggacggttagnggtacgtcgtaggggccgaagggacccgacggtcgacccgtcgtccctcacgtcccncccgacccgaaggggccccagtccggtcccttacccccgtcggccctaccccgtccctaccgacgacgccaccgttcggacgggggccacgacggccggtccccgtcggggccttggcccctggtaccgtaaacgggtacccttaaccgtttcccncggttaacgccggtccgtcggtcgacgggcccggggtcgaaccgggg

SEQ ID NO: 356121 - DNA, 585 bp, Homo sapiens
  misc_feature: GZ8MTXP02HPBUR.45.78.H01.1.454.CMB.2.raw
  modified_base (191)..(191): a, c, t, g, unknown or other
  misc_feature (191)..(191): n is a, c, g, or t
  modified_base (225)..(225): a, c, t, g, unknown or other
  misc_feature (225)..(225): n is a, c, g, or t
  modified_base (246)..(246): a, c, t, g, unknown or other
  misc_feature (246)..(246): n is a, c, g, or t
  modified_base (284)..(284): a, c, t, g, unknown or other
  misc_feature (284)..(284): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtncagtcgtgggctgaggtgaagagccgtgggcctnagtgagtctctgcaggtctcnggactacaccttcaccggctactatatacacgtgggtncgacacggcccctggaacaggtcttggagtgggagtggatggataccaaccgtaacaagtggtacggacaacgaaaccttatcgaccaagagtaacgtttcgacggggactacgggtacacgatacgaccgaggtacacgtaccgatcagacacgacgccctaagagtacggacgacgtagacgaccgaggacgtaggacgtacgttacgacgtacgaaccgtacgggtaccgttattaacgttcgcggtcgacggtaaggagtaccgacggtaagttacgttaggtttttaggtaacggg

SEQ ID NO: 356122 - DNA, 588 bp, Homo sapiens
  misc_feature: GZ8MTXP02HY4OC.45.78.H01.1.454.CMB.2.raw
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (367)..(367): a, c, t, g, unknown or other
  misc_feature (367)..(367): n is a, c, g, or t
tcagacgcgatcgacacgaccggtgctcgatttagtgtgagtagtttgggtttgggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggcagtcagagtattagtactggtgctggtatcagcaagaaacagggaaacnccctaagcctacngctactagtagcatactagtttagaaggtcgggtaccatcgaagtcagcgcagtgatcgtaggacagtacttcactctcaacctancagcagcctgacagtcctagacttagtatttcgaattaactttattactacgacctaaagtagttatagttaattagttacgtttacggacggttaccggaacggtaaaacgggggtaaccgtaaaaggggtacgtaaaacgtacgtaaaaacgtacgtacggttacgacgttacggaactaacctaacgttccgttacttaccttacttacctttccccg

SEQ ID NO: 356123 - DNA, 652 bp, Homo sapiens
  misc_feature: GZ8MTXP02F8AIV.45.78.H01.1.454.CMB.2.raw
  modified_base (387)..(387): a, c, t, g, unknown or other
  misc_feature (387)..(387): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagagccgtggggcctgagtgaggtctctgcgaaggtcttcgtggactaccaccttcgaccggtctactatatacacgtgggtgccgacgacggcccccgtaggacgaagggtcttaggaggtgggagtggggatggaactaccaaacctaacgagtggtacgacaacaaacgtntgacaacgtaagtaacgtttcgaaggggactaacggggtacctaaccgagtaccgaaaccggacggggaaacctaccggtaccaagtacgaacggaccaaccgaacggtaccctaaacgacggttacggggacgtccggtaaggaccgacgggaacggccgtaaggacgtacgtacgtacggaacggaccggaccgggtaccgttagtacgttacgtggcggtacgaaggacgacggtaacgtatttacggttagtttggtaagg

SEQ ID NO: 356124 - DNA, 616 bp, Homo sapiens
  misc_feature: GZ8MTXP02IN4TP.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagagccgtgggcctgagtgagtctctgcaagctcgtgatcacctcaccgctactatatacacgtggtcgacgacgacggtccccgtaggacgaaggtctttaggaggttgggaagtggggtagtacgggtaactaccgtaaaccctaaccgaaagtgggtacggacaaacgtaaactactcgacaacgaagtacgttcgagggcgtagggtcacgagtacgacgaggacctacgtaccgatcaacgacaacgacgacctacgagtcgagcgagacgcgaagtcgagaagacgtcaacggaccgacggaccggttaccgtagttaaacgttacgtcggtacgacgggaaggtacggaacggtaacggttaacgtttaacggtttaggtttttacgggtttaacgggg

SEQ ID NO: 356125 - DNA, 663 bp, Homo sapiens
  misc_feature: GZ8MTXP02HQ1LH.45.78.H01.1.454.CMB.2.raw
  modified_base (245)..(245): a, c, t, g, unknown or other
  misc_feature (245)..(245): n is a, c, g, or t
  modified_base (280)..(280): a, c, t, g, unknown or other
  misc_feature (280)..(280): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtgggctgagtgagtctctgcaggcttnggatacacctcgaccgctactatatacacgtggtncgacacggcccctggacgaaggcttggagtggagtgggatggatacctaaaccctaacgaaagttcgggtacggaaccaacgtaaaacctagtcgaaccaacgtaaaggttaaacgtttccggaaggggtaccgtaacggggtacccaaaccgaacgttacggaaccggtaacggggaacccgtaaccggttacccaacgtaccgacggacctaccgaaccgtacccttaacgacgtagggacgacgacggagaccggaggtccgaggacgacgtacgacgacggaaccggtaccgggtaccgttaggttacttacgacggttacgacggaaggacggtaacgtaacggttaagtttacggttaggtttttacgggttaaggg

SEQ ID NO: 356126 - DNA, 613 bp, Homo sapiens
  misc_feature: GZ8MTXP02I23B9.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattacgtgtgcgagaggcgaggtaattacgtagtttttgggagttggtttattcgggtaacggttagtggggtacgttcggtgggggaccgaacggggaccgacgggtccacccgtctccctcacgtccctacccgaccgaacggggccctaacgtcccggtcccttcccccgtcggccctacccgtccctaccgaacgcgccacccgtcggtcggggcaacgcgccggccgtcggctcggtcctcggacgacggtacctaccgttcctacgtaacgtccgtacgttcgaggcggcggtacgtcggg

SEQ ID NO: 356127 - DNA, 587 bp, Homo sapiens
  misc_feature: GZ8MTXP02HOEZP.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctccaccatggactggacctggaggatcctcttcttggtggcagcagccacaggagcccactcccaggtgcagctggtgcagtctggggctggaggtgaagaagccgtggggcctcgagtgaaggtctcgtgcaaggtcttgtggatacaccttcaccggctactatatacacgtggtgcgacacggcccctggacgaaggctggagtggagtgggatggatacgaacctaacaagtggtaggacaacgaaactatcgacaacaagtaagtttacgagggacgacgggtacacgatcgacgaggacacgtacatacagacacgacgtacctaacagtacggaagtcgtagacgacggacggtcgtaggaacgtacgtacgtaaggaccgacgtaccgggaccggttagttaacgttacgtgtacgacggaaggcggacgtaaggtaatttacggttagttttagggtttaaggg

SEQ ID NO: 356128 - DNA, 594 bp, Homo sapiens
  misc_feature: GZ8MTXP02FHZP1.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtagaagaagccgtggggcctgagtgaaggtctcctgacaaggcttctggactacaccttcaccggctactatatacacgtggtgcgacacggcccctggacaggctgagtggatgggatggataccaacctaacaagtggagacaacaaactagtcgacaacagtaaagttcgaggcgagggtacacatgaacgaggacaccgtcaatccagaccaacagaccctagagtacgggagaccgtgaacggtcgaaggtcgtacgggaagacgttacgacggaaccggaccgaccggggtaccgttaggttaacttaccgtaggtcggaacggaaggaggggaccgtaagggtaactttaacgggttacggttttagggttaacgggg

SEQ ID NO: 356129 - DNA, 304 bp, Homo sapiens
  misc_feature: GZ8MTXP02JNTMS.45.78.H01.1.454.CMB.2.raw
  modified_base (258)..(258): a, c, t, g, unknown or other
  misc_feature (258)..(258): n is a, c, g, or t
  modified_base (300)..(304): a, c, t, g, unknown or other
  misc_feature (300)..(304): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagtaagtttcagggcagggtcaccatgaccagggacacgtccatcagnacagcctacatggagctgagcgggctggacaaggcgcatagnnnnn

SEQ ID NO: 356130 - DNA, 669 bp, Homo sapiens
  misc_feature: GZ8MTXP02JMTRY.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgacagggacacgtccatcagcacagcctacatggagctgagcaggctagagatcgtgaccgaacgacggccgtagtacttacgtggtgcgaggaggacacggtaaattacgtagtttttaggaggttggttagttcgggacggttagtggggtaccgttcggtacgggggaacccgaagggggacccgtacgggtccgaacccgttcctacccgttcaccggtcccctaacccgaacccgtaaacccgggggtcccctaacgttcccggtccccgtttccccccgtcgggaccccctaaccccgtcccttacccaacggacgaccgtacccgtcgggtcgggggccaacgccggccggtccgcgggtctcgccgtcggaccgtaaacggccttacccgtctaccgaagtcgcggtactggacggcggtcgccgg

SEQ ID NO: 356131 - DNA, 574 bp, Homo sapiens
  misc_feature: GZ8MTXP02G3MG1.45.78.H01.1.454.CMB.2.raw
  modified_base (290)..(290): a, c, t, g, unknown or other
  misc_feature (290)..(290): n is a, c, g, or t
  modified_base (548)..(548): a, c, t, g, unknown or other
  misc_feature (548)..(548): n is a, c, g, or t
  modified_base (562)..(562): a, c, t, g, unknown or other
  misc_feature (562)..(562): n is a, c, g, or t
  modified_base (571)..(571): a, c, t, g, unknown or other
  misc_feature (571)..(571): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatcngacgacacggccgtgtattactgtgcgagaggcaggaattacgatttttaggagttggttattcggacggttagtgggacgtcgtagggggacctaaggggaccacgggtcaaccgtctcccgtcacgcctccgaccacgggcccacgtccgtccttcccccgtggccctaaccccgtcctaccgaacgacgaccacccgtcgtcggggcacgacgccggccgtcgggctcgccgtcgtacgacggtactacgttccncggaatcgcgttcngacgcggcncgg

SEQ ID NO: 356132 - DNA, 571 bp, Homo sapiens
  misc_feature: GZ8MTXP02FPKXA.45.78.H01.1.454.CMB.2.raw
  modified_base (188)..(188): a, c, t, g, unknown or other
  misc_feature (188)..(188): n is a, c, g, or t
  modified_base (316)..(316): a, c, t, g, unknown or other
  misc_feature (316)..(316): n is a, c, g, or t
  modified_base (509)..(509): a, c, t, g, unknown or other
  misc_feature (509)..(509): n is a, c, g, or t
  modified_base (557)..(557): a, c, t, g, unknown or other
  misc_feature (557)..(557): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaanaatggtggcaacaaactatgcacagaagtttcagggcagggtcaccatgaccagggacacgtccatcagcacagcctacatggagctggagcgaggctgagatcgtagacgacacggcgtgtattacngtgcgaggagcaggtaattagtagttttggagtggttacttcggacggttagtggacgtcggtagggggacccaaagggaccctacgggtctaaccgtctccctgaccgcctacccaaccgaacggtcccacgttccggtcctcccccgtgtcccaaccctccaccacgacgcacccgttcgcggggacacgngccgccgtggcctgccgtcggacaacggctacgcctacgcgtcgcgtnagcggcggctacgg

SEQ ID NO: 356133 - DNA, 569 bp, Homo sapiens
  misc_feature: GZ8MTXP02J1JNY.45.78.H01.1.454.CMB.2.raw
  modified_base (481)..(481): a, c, t, g, unknown or other
  misc_feature (481)..(481): n is a, c, g, or t
  modified_base (542)..(542): a, c, t, g, unknown or other
  misc_feature (542)..(542): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactccccaggtgcagctggtgcagtcgtggggctgaggtgaagaagccgtggggcctcgagtgaaggtctcctgacaggtcttcgtggatactaccttcaccggctactatatacacgtgggtgcgacgacggcccctggacaagggtcttggaggtggagtgggatggactaccgaaaccctagaagtgggtaggactaacgaaaactagtcggacaacgtaggtaagtttcgaacggggtcacggggtaccaaccgtagacgaaccgagggaccacgtaccatacgacgacacacgactacagtgganccgtagacgcggacggacgtgagctacgagacggcacggcgtagtactcgacggtgacggngacgacgagtagtagtaagtttgtagg

SEQ ID NO: 356134 - DNA, 544 bp, Homo sapiens
  misc_feature: GZ8MTXP02HV4P3.45.78.H01.1.454.CMB.2.raw
  modified_base (197)..(197): a, c, t, g, unknown or other
  misc_feature (197)..(197): n is a, c, g, or t
  modified_base (251)..(251): a, c, t, g, unknown or other
  misc_feature (251)..(251): n is a, c, g, or t
  modified_base (268)..(268): a, c, t, g, unknown or other
  misc_feature (268)..(268): n is a, c, g, or t
  modified_base (330)..(330): a, c, t, g, unknown or other
  misc_feature (330)..(330): n is a, c, g, or t
  modified_base (338)..(338): a, c, t, g, unknown or other
  misc_feature (338)..(338): n is a, c, g, or t
  modified_base (364)..(364): a, c, t, g, unknown or other
  misc_feature (364)..(364): n is a, c, g, or t
tcagacgcgatcgacacgaccggtgctcgatttagtgtgagtagtttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtagganacagagtcaccatcacttgccgggcagtcagatattagtactggtgctggtatnagcagaaacaggaaacncccctaagctcctgctctataagcatctaagttagaaagtgggtaccatcgaagtcagccgnagtgatcnggacagattcactcctacacatcagnacgctgcagctagatgtattgacttaaacttcttacgtacgactaaacgtagtaatagtaattagtttagtaccggtacgtttacggacgtaaacgggaaccgtaaagggtacgaaaactacgaaaacgacgttcgtaggtactaacggactacctactacgttcttacctttacctccg

SEQ ID NO: 356135 - DNA, 677 bp, Homo sapiens
  misc_feature: GZ8MTXP02GW0EQ.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcaacacacgcctacagtggagctagagcgaggctgagatctgacgacacggccgtgtatactgtgcgagaggcaaggtaatacgtattttggagttggtttatcgggtacggtagtcgggtacgtcggtacgggggaccgtaaacggggacccgtaacgggtccaacccggttcctcccgtaccgaacgtccccgtacccgacccggacgggccccgacgttcccggttcccttcccccgtccgggaccctacccccgttacccgtacccgaacggaccgtacccgtaacccgttccggtacgggggacccaacggaccgggccccgggtccgtcgggggccttcggcccgttacgggtacctaaacggggtaccttaccgtccgtacgacgtccgcgtacgtcggacggccggcgtacggacg

SEQ ID NO: 356136 - DNA, 507 bp, Homo sapiens
  misc_feature: GZ8MTXP02FPK42.45.78.H01.1.454.CMB.2.raw
  modified_base (284)..(284): a, c, t, g, unknown or other
  misc_feature (284)..(284): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgagtgaagagcctgggcctcagtgaaggtctcctgcaaggcttctggatacaccttcaccggctactatatacactgggtncgacaggcccctggacaagggcttgagtggatgggatggatcaacctaacaatggtgcacaaactatgacacagaagtttcaagggcagggtcaccatcgaccagggacacgtccagtcagcacagcctacatggacgctagagcgagcgtgagagtctagaacgacgacggcctaggtactacgtgtgcgaagacggacaggaattacgtagttttagaagg

SEQ ID NO: 356137 - DNA, 625 bp, Homo sapiens
  misc_feature: GZ8MTXP02FV2EI.45.78.H01.1.454.CMB.2.raw
  modified_base (251)..(251): a, c, t, g, unknown or other
  misc_feature (251)..(251): n is a, c, g, or t
  modified_base (485)..(485): a, c, t, g, unknown or other
  misc_feature (485)..(485): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagctgggcctcagtgagtctctgcaggctctggatacnccttcacgctactatatacacgtgggtgcgacacggcccctggacaagggtcttggagtggagtggggatggatacgaaccctaagaacgtgggtaggacaacgaaaaccttgtcggacaaacgtaaggtaaacgtttcggaaggggacctaggggtaccacgtagtacgaaccgtaggggacaaccgtcccgaatcgaagacacaacgacctaacagtggacgcgtagaacgngaacgcgtaggagtacgttacgacgaaaccgccgtaccgggtaccgttagttaaacgtttcgtacggtcggaacggaagggtaacggacggtaaaacgggttaagtttaaacggtttaggtttttaggggtttaaacggg

SEQ ID NO: 356138 - DNA, 669 bp, Homo sapiens
  misc_feature: GZ8MTXP02JLR1X.45.78.H01.1.454.CMB.2.raw
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (636)..(636): a, c, t, g, unknown or other
  misc_feature (636)..(636): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctggaggtgaagacgccgtgggcctgagtgaagtctcctgacgaggtcttcgnggataccnccttcgaccggtctacgtatatacacgtgggtcacgacacggtccccgtggaacgaagggtcttaggacggttagggagtacggggattcgggaactaccctaaaacccgtaaagaacgtcggggtagaaccctaaacgaaacgttacgtcgaaccgtaaacgtaaaggttaaacggtttcgggaagggggtacctaacgggggttaccacccgtaagtaccggaccggtaaacggacccgtaacgtacccgaagtacccgaagacccgaaacgtacgtacccctaaatacgggtcggacgccgttagacgcgaggcgtaggacgtacgtacgaggaaccgcggacgtcgtagtaactcgtaggcgacggaagnggaacgttaggattacggttagtttaggtaagg

SEQ ID NO: 356139 - DNA, 607 bp, Homo sapiens
  misc_feature: GZ8MTXP02H8WE2.45.78.H01.1.454.CMB.2.raw
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
tcagacgcgatcgacacgaccggtgctcgattttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtgggcctcgagtgaggtctccgtgcaaggtcttcgnggatacaccttcgaccggcttactatactacacgtggggtncggacgacgggcccctggaaccgaagggtcttaggaggttcgggagtgggatggactacaacctanatggngacaacaacttngcaanagtagttcgacgggctacgggacctacgagtacggaaccgaggggaaccctaacgttcccgaaatccgaacgtccaaaccgacggtaccctaaacctaggtacggagaccgtaggacgaccgtagggctaggagacgtagtcgaacgacgacggtcctaggtacttacgtaggtcgacgaaggaccggtacgaaggttaactacggttgtttttaacgggagg

SEQ ID NO: 356140 - DNA, 578 bp, Homo sapiens
  misc_feature: GZ8MTXP02IES0E.45.78.H01.1.454.CMB.2.raw
  modified_base (248)..(248): a, c, t, g, unknown or other
  misc_feature (248)..(248): n is a, c, g, or t
  modified_base (257)..(257): a, c, t, g, unknown or other
  misc_feature (257)..(257): n is a, c, g, or t
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (292)..(292): a, c, t, g, unknown or other
  misc_feature (292)..(292): n is a, c, g, or t
  modified_base (455)..(455): a, c, t, g, unknown or other
  misc_feature (455)..(455): n is a, c, g, or t
  modified_base (470)..(470): a, c, t, g, unknown or other
  misc_feature (470)..(470): n is a, c, g, or t
  modified_base (523)..(523): a, c, t, g, unknown or other
  misc_feature (523)..(523): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctctgcaggctntggactacnccttcaccgtctactatatacncgtggtcncgacncggcccctggacgaggtcttggagtgggagtgggatggactaccaaaccgtaacagtcggtgacaactaaactgtcgacgaacgtaagtagttcgaggggtcgacgggtaccaaccgtagtacggaacgagggaccctacgtccaatcgagacacacgcctanacgtgacgcgtaagngacgaggtcaggagactcgagaaccggctaccgggtcttagtacgtttacggnggtacgaggaacgaacggtacgtaacggttagtttacggtttagtttagggtacg

SEQ ID NO: 356141 - DNA, 596 bp, Homo sapiens
  misc_feature: GZ8MTXP02I1K7G.45.78.H01.1.454.CMB.2.raw
  modified_base (262)..(262): a, c, t, g, unknown or other
  misc_feature (262)..(262): n is a, c, g, or t
  modified_base (496)..(496): a, c, t, g, unknown or other
  misc_feature (496)..(496): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgcaaggcttctggatacnccttcaccggtctactatactacacgtgggtgcgtacgcggtcccctggacaagggcttggagtggagtgggatggactacaacctaacagtggtgacaacaaactatcgacaacgagtaacgttcgagggacgtaggggtaccacgtacgtacggaacccgaggggaacctacggtccaacgtacgacgacacgacgtacctaaccgagtagacgtcgtacgacgacgacggngtagagacgtcgtacgacgacgaccggtaccgtagtacgtttacggcgtacggacgaaggacgtacgtaacggtaagtttacggttacggtttaggtagg

SEQ ID NO: 356142 - DNA, 650 bp, Homo sapiens
  misc_feature: GZ8MTXP02G27FB.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctagagatctgacgacgacggccgtgtatactgtgcgagaggcaggaattacgagttttaggagttggttagttcggacggttagtcgggacgtcggtcggggaccgaagggacccgacggtccgaccgtccttccgtcacgtccctcccgaacgaccggcccacgtccgtacccttcccccgtcgcccctacccgtccctaccgaacgacacccgtacccgtcggtccgggggacacggaccggcccgggtcccgtcgggtccgtccgggtcccgttcgggtaccgaaacggtaccgttaacccgttcccgtaccggtaaccgttccggtaccgtccgtcggtaccgggtccggggcggtaccgggg

SEQ ID NO: 356143 - DNA, 829 bp, Homo sapiens
  misc_feature: GZ8MTXP02G0Y4C.45.78.H01.1.454.CMB.2.raw
  modified_base (257)..(257): a, c, t, g, unknown or other
  misc_feature (257)..(257): n is a, c, g, or t
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgacagggacacgtcatcagcanagctacntgganctgagcaggctgagtactctcgacgacgacggtcctagtacgttacgtggtcgaccggtagacggtcgtaaggtaacgtttacgtagtttttacgggagtttaggttacgttccgggaacggttagttcggggtaccgttacggtacgggggaccctaaacgggggtaccctaacgggtccgtaacccgttccgttacccgtacgtaaccgtcccgtaacccgtaaccggtaaccgggtacccctacggttcccggttaccccgtttcccccgtaggtaccccgtaccccgttacccgtaacccgtaacggtacccggtacccgtacccggttccggtaaccgggggtaccctaacgggtacccgggtacccgggttaccccggttaacggggtacccgttccggtacccccgggttacgggtttaaacccggtaaaaccgggggtaccccttttaaccccggtttacccggttaaccggtaacccggtttaccgggttaccccggtttacggtaaccggggttacccgggtacccgggggtttaccggttaacccgggg

SEQ ID NO: 356144 - DNA, 609 bp, Homo sapiens
  misc_feature: GZ8MTXP02I1QY8.45.78.H01.1.454.CMB.2.raw
  modified_base (321)..(321): a, c, t, g, unknown or other
  misc_feature (321)..(321): n is a, c, g, or t
  modified_base (344)..(344): a, c, t, g, unknown or other
  misc_feature (344)..(344): n is a, c, g, or t
  modified_base (541)..(541): a, c, t, g, unknown or other
  misc_feature (541)..(541): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaggtctctgcaggcttcgtggatacaccttcaccggctactatatacacgtggtgcgacacggcccctggacaaggtctggagtgggngtggggtagatccaaaccctaanaacgtggtacggcaaactaaactatgcaacaaggtaaaggtttcagggggaccaggggtaccacgtagtacggaaccgaggggaaccacgtaccacgtcagccacacgacctaacaagtcggagctagggacgccgaagggctaaggacgtactacgacggacgtaaccggagggttacccgtgttaaacttacggnggttacggaccggagggtggaacgtaggtttaaaacgttacgttaggtttttaggacgggttttaggg

SEQ ID NO: 356145 - DNA, 587 bp, Homo sapiens
  misc_feature: GZ8MTXP02IK6OG.45.78.H01.1.454.CMB.2.raw
  modified_base (250)..(250): a, c, t, g, unknown or other
  misc_feature (250)..(250): n is a, c, g, or t
  modified_base (279)..(279): a, c, t, g, unknown or other
  misc_feature (279)..(279): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (535)..(535): a, c, t, g, unknown or other
  misc_feature (535)..(535): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtgggcctgagtgagtctctgcaaggtcttcnggatacaccttcaccggctactatatacncgtggncgacncggcccctggaacaggctggagtggagtgggatggactaccgaacctaactaggtggtcgaacaacgtaaactagcgacaacgtaaggttaacgttcggaggggcgacgggtaccacgactacgaaccgaggacctacgccatacgacgacacacgaccctaagtacgtaggactacgagaccgcggtaaggcgtagagtactcgtacgaacgtaccggacgggtccttagtaaacttcgtacgnggacgaaggaacgaggtaacggttaagttacggtttagtttaagggttacgg

SEQ ID NO: 356146 - DNA, 706 bp, Homo sapiens
  misc_feature: GZ8MTXP02JD3TU.45.78.H01.1.454.CMB.2.raw
  modified_base (563)..(563): a, c, t, g, unknown or other
  misc_feature (563)..(563): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcaggtcgtggggctggagggtagaaaggaacggccgtggggcctcgaggtaggaaggtcctcctgacgaaggtcttcgtggactaccacccttcgaccgtctactaatactacacgtggtgacgacgaccggccccgtaggaacgaagggtcttagggaggtaggaggtgggagtggactaaccgaaacccctaaaatacgtgggtacgaactaaactaaaacagtcgaacaaacgtaaaggttaaacgttacggggaacgggacggtaacgggtaccaaaccgtaaggtaccggaacccggtaaggggaacccaccggtacctaaacgaccgaacggaccaaccgtacgacccgtaagacgttagggaacncgtaggacgacggaacggtgtaaggagtaacgtcggaacggacgaacggtacccggtaggttaacgttacgttacgtggtacggagtaagggtaccgggtaagtaacgggttaaagttacggttttaggtttggttaaagggg

SEQ ID NO: 356147 - DNA, 658 bp, Homo sapiens
  misc_feature: GZ8MTXP02G729G.45.78.H01.1.454.CMB.2.raw
  modified_base (276)..(276): a, c, t, g, unknown or other
  misc_feature (276)..(276): n is a, c, g, or t
  modified_base (458)..(458): a, c, t, g, unknown or other
  misc_feature (458)..(458): n is a, c, g, or t
  modified_base (538)..(538): a, c, t, g, unknown or other
  misc_feature (538)..(538): n is a, c, g, or t
  modified_base (638)..(638): a, c, t, g, unknown or other
  misc_feature (638)..(638): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagtaagtttcagggcagggtcaccatcgaccgaggacacgtccatcagcacagcctacgatgganctgagcgagcgtagacgctacgagacgacgaccggcgtagttacgtagtgtacggacgagacggaagtaggtaaattaggtttacgtttggagtttggtaacggtttccggaggttagtggggtactacggggtacggggaccgaacggggtaccgtacgggtactaccgtccttacccganacccgcctaacccgacgaaccgtccacgtcccgtaccctcccgtccgaccctaaccctcccgacgaaacgtccgtacccnccgttacgggaccggccaaccggcggaccccgggcgttcggggaaccttcccgaacggtcgtaccgtaaacgtcctttaccgacgttacgcgtccgtaancggtaggccggttacgcgcg

SEQ ID NO: 356148 - DNA, 565 bp, Homo sapiens
  misc_feature: GZ8MTXP02FF2Z5.45.78.H01.1.454.CMB.2.raw
  modified_base (273)..(273): a, c, t, g, unknown or other
  misc_feature (273)..(273): n is a, c, g, or t
  modified_base (387)..(387): a, c, t, g, unknown or other
  misc_feature (387)..(387): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
tcagacgcgatcgacacgaccggtgctcgatttagtgtgagtagtttgggtttgggggtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggcagtcagagtattagtaactggttggctggtatcagcaagaaaccagggaaacncccctaagcctcctgctactataaggcattcgtaagtttacggaaaaggtcggggtacccaagttaccgaaaggttcaaggcggaccaggtggatcgtgggacagtatcactcncacatcancancctgcngcctgatgtaatttgacttaacgtttatactcgaccaaagtagttatagtattaagttattaccggaccggttacggaccgtaaaaggggaaccgaaaggtagaaactaacaaaacgtaacgtgtacggctagccactatcgttctactactactttcccg

SEQ ID NO: 356149 - DNA, 643 bp, Homo sapiens
  misc_feature: GZ8MTXP02HJ252.45.78.H01.1.454.CMB.2.raw
  modified_base (253)..(253): a, c, t, g, unknown or other
  misc_feature (253)..(253): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtgggcctcgagtgaaggtctctgcaggcttcgnggatacaccttcaccggctactatatacacgtggtgcgacgacggccccgtggaacgaaggcttaggaggtggagtgggatggactaccaaacctaagaagtcggtacggacaacgaaactagtcgacaacgaagttaacgttacgaggggacaacgggtacaccagtacgaccgagggaccacgtaccaatacgacgaccaacgacgacctaacgtaggtacggacgacgtaggaacgcggaacggccgtaggacgtaacgttacgacggaaccgaaccggtaccgggtacccgttagggttaactttacggcggttacgggaccggtaaggaacgggtaacgtaaagggtaaacgtttacgggtttaagtttttacggggtaacgggg

SEQ ID NO: 356150 - DNA, 586 bp, Homo sapiens
  misc_feature: GZ8MTXP02G38NK.45.78.H01.1.454.CMB.2.raw
  modified_base (271)..(271): a, c, t, g, unknown or other
  misc_feature (271)..(271): n is a, c, g, or t
  modified_base (423)..(423): a, c, t, g, unknown or other
  misc_feature (423)..(423): n is a, c, g, or t
  modified_base (582)..(582): a, c, t, g, unknown or other
  misc_feature (582)..(582): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtcatcagcacagcctacatgganctgagcaggctgagatctgacgacgacggccgtagtattacgtgtcgtcgagaggcaaggaattacgtagtttttggacgttggttattcgggacggttagtggtacgtcgtcggggaccgaagggacccgaggtccaccgtctcctcgacnccctcccgaccgacgggtcccagttccggtacccttacccccgtggccctacccgtcctaccaagacgtaccaccgtcggtcggggcacgcggcgcccgtggctcgcgtcggtacacgtacgttaccgtccacgcttcggcttacgtcgcggtccgggngtcg

SEQ ID NO: 356151 - DNA, 878 bp, Homo sapiens
  misc_feature: GZ8MTXP02HDNVL.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcacatgaccgagggacacgtccatcagcacagcctacatggagctgagcgaggcgtagagatcgtagacgacgtacggcgtagtattacgtggtcgacgtaggacggctaagggtaactttacggtagtttttagggtagttaggttagtccgggtaaggttagtcggggtacgttacggtcgggggaccgtaacggggacccgtacgggtacccgtacccggtacccttcccgtacccgaccgtacccgtacccgaaacccggacccgggtaccccgtaaccgttccccggggttacccctttccccccggtacgggtaccccctaaacccccggtttccccctaacccgtaaaccggaccggttaacccccgtaaccccgggtttaacccggggtccgggggggaacccctaaaaccgggtacccgggggacccccgggggttccccgggttaacccgggggttaccccgttacccggggttccccgggttaaccggggtttaaaccccggaaaacccgggttaaccccgtttaaaccccggtttccccggttaaaaccgggttaacccggttaccccgggttcccgggttaccgggtttaacccggggaccggggtttaccccgggggaccgggtttacccggggg

SEQ ID NO: 356152 - DNA, 636 bp, Homo sapiens
  misc_feature: GZ8MTXP02GACJB.45.78.H01.1.454.CMB.2.raw
  modified_base (388)..(388): a, c, t, g, unknown or other
  misc_feature (388)..(388): n is a, c, g, or t
  modified_base (487)..(487): a, c, t, g, unknown or other
  misc_feature (487)..(487): n is a, c, g, or t
  modified_base (505)..(505): a, c, t, g, unknown or other
  misc_feature (505)..(505): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtagaaggtctcctgcgaaggtcttcgtggataccaccttcaccggtctactatatacacgtgggtcgcgacacggcccctaggaacgaagggcttaggagtgggagtggggatggaataccgaaaccctaacgaaagttgggagaccaacaaaacttntgacaaacgtaaggtaaacgttcggaagggtcacggggtaccaacagtacgaaaccgagggtacccacggtcccaagtccagaccaacgagaccctaanaacgtggactcgaggacncgaggctagggatagtcgaggacccgtaacggccgggtaccgttagttaacgttacgtcggtacggacggaaggtacgggaaccgtaaaagggttaatttaaccgggtttaggttttacggggttaaaggg

SEQ ID NO: 356153 - DNA, 688 bp, Homo sapiens
  misc_feature: GZ8MTXP02FU0T6.45.78.H01.1.454.CMB.2.raw
  modified_base (249)..(249): a, c, t, g, unknown or other
  misc_feature (249)..(249): n is a, c, g, or t
  modified_base (398)..(398): a, c, t, g, unknown or other
  misc_feature (398)..(398): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagcccggcctccatctcctgcaggtctagtcaaagcctctatacagggatggaaacnctcacttgaattggttacaacgagaggccaggcccaatctaccaaggcaccttaatttagtaaggtttcaaccggatcgtcggggtacccagacagattcagcgcagtgggtcaggcatgatttcactactagaaaattaggtaggggnggtagcgtggaaggagttggtttagggttaagtttattttacgtggtacctaagtttggaacgtaaaggggttaaccaacgtacggttaccgggtacccgtttaaccgttaaccgtttttcggggacccgtaaagggggaacccaaaggtccgttaaaggggaaaactaaccggtaaaaacgtaaccggttaggtacgggtaccttacggaacctaacccgtaaattccccgttaaggtttcctttaaaccgtaccgttttcccctttaacccccggccgtttaaacccg

SEQ ID NO: 356154 - DNA, 708 bp, Homo sapiens
  misc_feature: GZ8MTXP02GLO63.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgaggtgaaggtctccgtgcgaaggtcttcgtggactaccaccttccgaccggctactatatacacgtgggtgcgacgacggcccctggaacgaagggcttaggacgtgggagtggggatggactaccaaacctaacgtaagtgggtcgacaacaaaacttagcgacaaacgtaagtaacgtttacgaaggggtcgaacggggttaccaaccgacgtacgaaacccggacgggaaccgtaacccggtaccaagtaccgaacgaccaaaccgacggtaacccctaacgaacggttacgggaacgtacggttacggaacggcggaaacgggtccgtaagggaactacggtacggtacggaaaacggaccgaccggggttccggtaaacggttaacgtttacgagggtaccgggaggaacgggaacggtaacggtaaacggggttaaaatttacgggtttaacggtttttacgggttaagggg

SEQ ID NO: 356155 - DNA, 582 bp, Homo sapiens
  misc_feature: GZ8MTXP02IOCC2.45.78.H01.1.454.CMB.2.raw
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (270)..(270): a, c, t, g, unknown or other
  misc_feature (270)..(270): n is a, c, g, or t
  modified_base (275)..(275): a, c, t, g, unknown or other
  misc_feature (275)..(275): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcgtgggcctnagtgagtctctgcagctngatacactcacgntacatatacagtggncgacncggtcccctggaacgaggtcttggagtggagtagggatcggactaccaaaccctaacgaagtggtacgaccaacgaaaacttagtcggacaacgtaaggtaaacgtttccggaggggactaggggtaccacagtacggaaccgagggaaccacgtaccagtacgaacgccaacgacgaccctaacgagtcggacgcgtacgacggcgaaggcgtaaggagtaactcgacgtacgacgacggtccgtagtacttacgtgtacggacgaagacggacgtaaggtaactttacggttacgtttaggtagg

SEQ ID NO: 356156 - DNA, 539 bp, Homo sapiens
  misc_feature: GZ8MTXP02JZT10.45.78.H01.1.454.CMB.2.raw
  modified_base (429)..(429): a, c, t, g, unknown or other
  misc_feature (429)..(429): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaaggcttctggatacaccttcaccggctactatatacactgggtgcgacaggcccctggacaagggcttgagtggatgggatgggatcaaacctaacaatggtagacccaacaaactagtgacaacagtagtttcgaggggcagggtcaccgatcgaccagggacacgtcatcagcacacgacctacagtgggancgtagagcgagggcctagagtatcgtagaccgacgacggcgtagtattacgtggtgacgagaggctaaggaattacggtagttttgggagttcggtttaagtcggtaagg

SEQ ID NO: 356157 - DNA, 648 bp, Homo sapiens
  misc_feature: GZ8MTXP02I0EX4.45.78.H01.1.454.CMB.2.raw
  modified_base (319)..(319): a, c, t, g, unknown or other
  misc_feature (319)..(319): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccaggacacgtccatcagcacagcctacatggagctgagcaggctgagatctgacgacacggccgtgtattactgtgcgagnggcaggaattacgatttttggagttggttattcggacggtatgggacgtcgtaggggccgaaggggaccgacgggtccaacccgtcctccctccgacgccctcccaacccgaacggggccccaagtcccgggtccttaccccccgtggtccccgtaacccccgttccccgttacccaaacgacggacccacccgttccggtcgggggcctaaccggaggccccgggcccccgttcgggggccgtttcggcccgttacgggttccgaaacggggtacccttaaccgtttcccgtcgtaaccgtcgccggtctcggacgcggggctcgggg

SEQ ID NO: 356158 - DNA, 625 bp, Homo sapiens
  misc_feature: GZ8MTXP02GLN4J.45.78.H01.1.454.CMB.2.raw
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (265)..(265): a, c, t, g, unknown or other
  misc_feature (265)..(265): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagagccgtgggcctcagtgagtctcngcagctngatacactcacgctactatanacacgtggtgccgacgacggccccgtaggaacgaagggtcttggaggtgggaagtggggacttagggactaccgaaaaccctaacgtaagtacgggtaggacaaacgtaaaactagtgaccgaaacgtaaaggttaacgttccgaaggggaccggtaagggtacccaacgtaacgtaccggaaaccgagggtaaccctacccggttccaaggtcccaaggaccctaacggaacacccgtaaagagttccgggaatccgagggaaccgttgggaaccggtggtacggacgacgacgacgtacgacgacgtacggtacgtacgtacgtcgtagagaagagacgtacgtagtagtagtagtag

SEQ ID NO: 356159 - DNA, 542 bp, Homo sapiens
  misc_feature: GZ8MTXP02IOBRU.45.78.H01.1.454.CMB.2.raw
  modified_base (225)..(225): a, c, t, g, unknown or other
  misc_feature (225)..(225): n is a, c, g, or t
  modified_base (243)..(243): a, c, t, g, unknown or other
  misc_feature (243)..(243): n is a, c, g, or t
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
  modified_base (364)..(364): a, c, t, g, unknown or other
  misc_feature (364)..(364): n is a, c, g, or t
  modified_base (416)..(416): a, c, t, g, unknown or other
  misc_feature (416)..(416): n is a, c, g, or t
  modified_base (420)..(420): a, c, t, g, unknown or other
  misc_feature (420)..(420): n is a, c, g, or t
  modified_base (454)..(454): a, c, t, g, unknown or other
  misc_feature (454)..(454): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggagatcctcttcttggtggcagcagccacaggagcccactcccaggtgcagctggtgcagtcgtggggctgaggtgaagagccgtgggcctnagtgagtctctgcagctngatacactcacgntactatatacacgtgggtcncgacacgggtcccctagggaccgtaaagggtcttaggaggtgggagtggggatggactacaaccgtaacagtggagacaactaaactngacaacagtaagttcgaggcgaggtacacagtcgaaccgaggaccacgtcancgancactacgacctagagtgagcgtagacgcgagggngagacgtagtacgacggacgacgacggtacgtagtacgttcgcgtagacggaagcgtagtaaggttagtttagttaggtttaggtagg

SEQ ID NO: 356160 - DNA, 758 bp, Homo sapiens
  misc_feature: GZ8MTXP02IBPA6.45.78.H01.1.454.CMB.2.raw
  modified_base (300)..(300): a, c, t, g, unknown or other
  misc_feature (300)..(300): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagtaagtttcgagggcagggtcaccatcgaccgagggacacgtccatcagcacacgcctacagtggacgctggagcgaggctaggacgntacgtggaccggacgaccggggtcccggttagttactttaacgtggtcggaccggtaaggacgggtaccgaaagggttaaatttacggtttagtttttaggggagggtttggtttaaacgtttcggggtaacgggttagttcgggggtaccggtttcggggtacgggggaacccgtaaaacgggggccccgtaaaccgggttcccacccggttcccgtacccgtccgacccgtccccgtacccgaaacccggaaccggggtcccctaacggtccccgggttccccgtttcccccgccgggtacccctcccccgttacccgtacccgaacgaccgtccgtacccgtcgggtacgggggccaacggccggtccgggtcccggtcgggtccgtcggtccgtcggttacgaacggtaccttacgttccgtcgaacgtcgcgtcgacggtcggcggtcgcggg

SEQ ID NO: 356161 - DNA, 562 bp, Homo sapiens
  misc_feature: GZ8MTXP02JEXQ0.45.78.H01.1.454.CMB.2.raw
  modified_base (289)..(289): a, c, t, g, unknown or other
  misc_feature (289)..(289): n is a, c, g, or t
  modified_base (360)..(360): a, c, t, g, unknown or other
  misc_feature (360)..(360): n is a, c, g, or t
  modified_base (420)..(420): a, c, t, g, unknown or other
  misc_feature (420)..(420): n is a, c, g, or t
  modified_base (437)..(437): a, c, t, g, unknown or other
  misc_feature (437)..(437): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgagagcctgggcctcgagtgaaggtctcctgccaaggcttcgtggatacgaccttcaccggctactatataccactgggtncgacaggcccctggacaagggcttgagtggatgggatggatcgaaacctacgaatggtgacacaaaacttncgcaacagtaaattcgaagggcagggtcacgatcgacaggacacgtcagtcagacacganacctacatcggggaacncgtacgacgacgacggcgtagagtactcgacgaacgacgtaccggtaccgtagttacgttacgtacggtacgacggaacgacggtacggtaacggttaacgttacggtttagttttacgggtacg

SEQ ID NO: 356162 - DNA, 626 bp, Homo sapiens
  misc_feature: GZ8MTXP02GSB0C.45.78.H01.1.454.CMB.2.raw
  modified_base (443)..(443): a, c, t, g, unknown or other
  misc_feature (443)..(443): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctaatacgagggatggaaacactcacttgaattggttacaacagaggccaggccaatctaccaaggcgacctaaatttaataaggtttactaaccgggtactcgtcgggacccagacagtatcagcgcagtgggcaggcactgatttacacaatagtaaaagttaaggtagggtaggagtgtagaggtagtggttgtaagtttgtttactgtnagtgacgaaaggtaacacacgtcggtaccggtactaacgttttcggacgaacggggaacccgaaagtacgtagggtaaaactaccgaaaaacgtacgtacgggttaaggcgttacggtaccaaacccgttacgttaaccgttacgttaccgtttactacctttacccgtaccccgtacgtacg

SEQ ID NO: 356163 - DNA, 670 bp, Homo sapiens
  misc_feature: GZ8MTXP02JQX6Z.45.78.H01.1.454.CMB.2.raw
  modified_base (226)..(226): a, c, t, g, unknown or other
  misc_feature (226)..(226): n is a, c, g, or t
  modified_base (236)..(236): a, c, t, g, unknown or other
  misc_feature (236)..(236): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtgggcctnagtgaagtcnctgcaggctctggatacaccttcacgctactatatacacgtggtgcgacacggcccctaggacgaaggcttaggagtgggatggggataggataccaacctaaccgagtggtacggacaacaaactatcgacaacgtaaggtaagtttcgaggggtaccaagggggttaccaacccgtagtacggaaccggaacgggggtaacccaaccggttacccgaacgttacccgaacggacccgaacgaccgtaacccgttaaacctaacgggttaggggtaacgcccgggttaggaacggaccggtaacgggccgttagggaacgtacgttacggacgtaacggtaccgaccggggtaccgtaggttacgtaccgtgggttacgacggaaggaccggtacgtaaaaggtacgttaacggtttaggttttaggtaacgg

SEQ ID NO: 356164 - DNA, 553 bp, Homo sapiens
  misc_feature: GZ8MTXP02H28MU.45.78.H01.1.454.CMB.2.raw
  modified_base (252)..(252): a, c, t, g, unknown or other
  misc_feature (252)..(252): n is a, c, g, or t
  modified_base (269)..(269): a, c, t, g, unknown or other
  misc_feature (269)..(269): n is a, c, g, or t
  modified_base (378)..(378): a, c, t, g, unknown or other
  misc_feature (378)..(378): n is a, c, g, or t
  modified_base (470)..(470): a, c, t, g, unknown or other
  misc_feature (470)..(470): n is a, c, g, or t
  modified_base (519)..(519): a, c, t, g, unknown or other
  misc_feature (519)..(519): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagcgtggtgcagtcgtgggctggaggtgaagaagccgtgggcctcgagtgaaggtctctgcaggcttcnggatcgacttcaccggntactatatacacgtgggtgacgacacggcccctggacaaggctggagtggagtggatggatcaaaccctaagaacgtggtacggacaaactaaaacgtatcggaccaanaaagtaagtttaccaagggggtcaaggggtaccaaccgagtacgaccgaaggactacgtaccagtacacgcacagtacctacagtggagcgngagacgagcgaggatacgtctacgacgacgtacggcctagatttacggngtgagaagagacgagtagttacgttagtttagag

SEQ ID NO: 356165 - DNA, 695 bp, Homo sapiens
  misc_feature: GZ8MTXP02IJ1LW.45.78.H01.1.454.CMB.2.raw
  modified_base (368)..(368): a, c, t, g, unknown or other
  misc_feature (368)..(368): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgtagtcgtggggctggaggtgaagagccgtggggcctcgagtgaaggtctcctgcaaggcttcgtggatacgaccttcaccggctactatatacacgtgggtgcgacgacggcccctggacaagggtcttgagtggagtgggatggatccaaacctacgagtggtagacaacaaactntcgcacgagtaagtttacgaggggcagggtccacatcggaacaggggacacgtaccaacgtcacgacacacgtacctaacgtacgttacgggacgacgttaggaacgccgaagggtaccttaggaacggtacgttaccggtacggtaacccgggaaccgtaaccgggggttacccggttagggtttaaaccgtttaaccggttgggttaccgggtaacccggaaaggggttaaacggggaacccggttaaaacggggtttaaaacgttttaaacccgggttttaacgggtttttttacggggtaaaggggttttttaaaaccggggg

SEQ ID NO: 356166 - DNA, 515 bp, Homo sapiens
  misc_feature: GZ8MTXP02IWJLR.45.78.H01.1.454.CMB.2.raw
  modified_base (226)..(226): a, c, t, g, unknown or other
  misc_feature (226)..(226): n is a, c, g, or t
  modified_base (250)..(250): a, c, t, g, unknown or other
  misc_feature (250)..(250): n is a, c, g, or t
  modified_base (440)..(440): a, c, t, g, unknown or other
  misc_feature (440)..(440): n is a, c, g, or t
  modified_base (447)..(447): a, c, t, g, unknown or other
  misc_feature (447)..(447): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (494)..(494): a, c, t, g, unknown or other
  misc_feature (494)..(494): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctnagtgaaggtctctgcaaggcttcnggatacaccttcaccggctactatatacactggtgcgacacggcccctggacaagggcttggagtggatgggatggactacgaaccctaacgaagtggtcggacaacaaaactatgacaacagtaaagtttcaagggcaagggtcaaccagtacgaccgagggacacgtcccaatcagacacacgcctanactgacncagagcgagcgagagatcagacagccgcgtgacttcgngngagaagngacgagtatacgtagttagag

SEQ ID NO: 356167 - DNA, 601 bp, Homo sapiens
  misc_feature: GZ8MTXP02H4LOD.45.78.H01.1.454.CMB.2.raw
  modified_base (246)..(246): a, c, t, g, unknown or other
  misc_feature (246)..(246): n is a, c, g, or t
  modified_base (269)..(269): a, c, t, g, unknown or other
  misc_feature (269)..(269): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagctggggcctcagtgaagtctctgcaagcttnggatacacttcaccggctactanatacacgtggtgcgacacggcccctggacaaggcttggagtgggatgggatggactaccgtaaacctaaccgagtcggtaggaccaacaaaccttatgacaacgtaagtacggtttacgacggggactagggtacaccgagtacgaaccgagggacctacgtaccatacgacgaccacaacgaccttacagttaggacacggtagacgacgaacggtcaggagtatccggaacgaacggacgaccgggtaccgttacgttaacgttaccgtggttacgacggaaggtacggaacgtaacggtaagtttaccgttaggtttttagggtaaggg

SEQ ID NO: 356168 - DNA, 653 bp, Homo sapiens
  misc_feature: GZ8MTXP02JPMN4.45.78.H01.1.454.CMB.2.raw
  modified_base (320)..(320): a, c, t, g, unknown or other
  misc_feature (320)..(320): n is a, c, g, or t
  modified_base (638)..(638): a, c, t, g, unknown or other
  misc_feature (638)..(638): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggcgttgtatacgtgtgcgagnggcaggtaacttacgtagttttgggagttggtttacgttacgggaacggttagtggggtaaccgttcggtacgggggaccgaacggggacccgtacgggtacccgtacggttccctcccgtcgaccggtcccctacccgaacccgaccgggccccgtaacgtcccgggttccccttcccccgtacgggccccctaaaccccgtcccctaccgaacgacgacccgtaccctcgggtcgggggaccacgacggcccgtcccggtgggcctcggcctcgggtacaacggttacctaccgttcgtcgaacgttcgcgttcgngacggcggactacgg

SEQ ID NO: 356169 - DNA, 591 bp, Homo sapiens
  misc_feature: GZ8MTXP02JSWFF.45.78.H01.1.454.CMB.2.raw
  modified_base (235)..(235): a, c, t, g, unknown or other
  misc_feature (235)..(235): n is a, c, g, or t
  modified_base (370)..(370): a, c, t, g, unknown or other
  misc_feature (370)..(370): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagcccactcccaggtgcatctggtgcagtcgtggggctggaggtgaagaagccgtggggcctcgagtgaacggtcnctgacaaggcttcgtggataccaccttcaccggctactatactacacgtggtagcgacgacggccccgtaggacagggtctgagtggagtgggatggacaccaacctaacgtagtggtagacccaactaaacgtntcgacacgaagttagtttacgagggacgtagggacacgatacggaccgacggactacgtaccagtcacgaccacgacgactacgagtaggagtcgaggacgcgacggtcgacgacggtctacggacgaccgacgacgtaccgttagactagtcggacgacggaggacgtagtaagttaagttacgttaggtttaggacgtttaggttacgtagggtaacgg

SEQ ID NO: 356170 - DNA, 872 bp, Homo sapiens
  misc_feature: GZ8MTXP02HWSZ2.45.78.H01.1.454.CMB.2.raw
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctggaggtagaaggaacgccgtggggcctacgtaggtaggaacggttcctccgtggacgaaggtccttcgtacggacttaaccgtacccttaccgaccggtacctaaccttataactaaccgtacggttggggtacggcgaacccggtaccgggtcccccgttaggggaaccgtaaggggtcttagggtaggtagggtagtggggtaatgggtaactaaccctaaaccccgtaaacgaaggttcggggtacggaacctaaacgtaaaacgttgtacgacaaacggtaacggttaaacggtttaccggaacggggtacggtaccgggtacctaaaccgacgtaccgggaaccggaaacgggacccgtaaccggttacccaacgtacccgaacggaccctaaaccgaccggaaccccgttaaacgaacgggttaaacgggacgggttaccggtacgggaaagggtaccggtaaagggtccggtaaaggaacggggtactaccggttaccgggaaacccggtacggtaaaccccggggttcggtttaaacggtttacggtttaaccggtcggggttaccggaacgggtaaaggggaccggggtaaaacggttaaaacgggggtttaaaccgttttaacggggttttaacggttttttacgggggtaaacgggg

SEQ ID NO: 356171 - DNA, 577 bp, Homo sapiens
  misc_feature: GZ8MTXP02FQKTC.45.78.H01.1.454.CMB.2.raw
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (263)..(263): a, c, t, g, unknown or other
  misc_feature (263)..(263): n is a, c, g, or t
  modified_base (281)..(281): a, c, t, g, unknown or other
  misc_feature (281)..(281): n is a, c, g, or t
  modified_base (333)..(333): a, c, t, g, unknown or other
  misc_feature (333)..(333): n is a, c, g, or t
  modified_base (340)..(340): a, c, t, g, unknown or other
  misc_feature (340)..(340): n is a, c, g, or t
  modified_base (353)..(353): a, c, t, g, unknown or other
  misc_feature (353)..(353): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagctggggctcagtgaggtctcctgcaggtctcnggatacnccttcaccgntactatatacactgggtncgacaggcccctggacaagggcttgagtggatgggatggatacaaccctaanaagtggngactacaaaactntcgcacagtaagttcaagggcagggtccaccagtgacgaggacacgtccagtcagccaacgagaccctaagagtggacgtcgtagaagccgaggcgttaggagaagttccgaggaacccgtaacggtaacccggggtccgttaggttactttaaccgttggcggacggaaggtacgggacgtaaaggggttaacttacggtttaaggtttttacggtaaagggg

SEQ ID NO: 356172 - DNA, 556 bp, Homo sapiens
  misc_feature: GZ8MTXP02JRRLP.45.78.H01.1.454.CMB.2.raw
  modified_base (465)..(465): a, c, t, g, unknown or other
  misc_feature (465)..(465): n is a, c, g, or t
  modified_base (510)..(510): a, c, t, g, unknown or other
  misc_feature (510)..(510): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctctgcaaggcttcgtggatacaccttcaccggctactatatacactgggtgcgacgacggcccctggacaagggcttaggaggtggagtgggatggatacaaacctaacaagtcggtggacaacaaactatcgcaacagtaagttcagggcagggtcacatcgacgagggacacgtccatacgacgacacacgacctacagtggagcgtagacgacgaggtcgagganagtacgaggaacgacggacggtccgtagttaacttacgttacggngaggaaggacgacggtaacggtaagtttacgtttagtttaggtagg

SEQ ID NO: 356173 - DNA, 571 bp, Homo sapiens
  misc_feature: GZ8MTXP02FN7CK.45.78.H01.1.454.CMB.2.raw
  modified_base (252)..(252): a, c, t, g, unknown or other
  misc_feature (252)..(252): n is a, c, g, or t
  modified_base (528)..(528): a, c, t, g, unknown or other
  misc_feature (528)..(528): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagagccgtgggcctgagtgaaggtctctgcaaggtcttcgnggatacaccttcaccggctactatatacacgtgggtgcgacacggcccctaggacaagggtcttggagtgggagtggggatggactacgaaacctaacgaagtggtagacaaacaaactagtgacaacgagtaacgttcgagggcgagggtacaccagtcgaacgagggaacacgtacaatcgacgacgaaccacgaccctaagagtcggagcgtaggcgcgtaggcgtaggagacttcgacgaccgacgacggtccgtagtaaacgttcgtacgngacgaaggacgacgaggttaactttacggttagtttggtaagg

SEQ ID NO: 356174 - DNA, 550 bp, Homo sapiens
  misc_feature: GZ8MTXP02IUND2.45.78.H01.1.454.CMB.2.raw
  modified_base (225)..(225): a, c, t, g, unknown or other
  misc_feature (225)..(225): n is a, c, g, or t
  modified_base (245)..(245): a, c, t, g, unknown or other
  misc_feature (245)..(245): n is a, c, g, or t
  modified_base (252)..(252): a, c, t, g, unknown or other
  misc_feature (252)..(252): n is a, c, g, or t
  modified_base (268)..(268): a, c, t, g, unknown or other
  misc_feature (268)..(268): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (357)..(357): a, c, t, g, unknown or other
  misc_feature (357)..(357): n is a, c, g, or t
  modified_base (512)..(512): a, c, t, g, unknown or other
  misc_feature (512)..(512): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagagccgtgggcctnagtgaagtctctgcagctcnggatacncttcacgctactatanacacgtggtcgcgacacggcccctggacgaaggtcttgaggtggatgggatggataccaacctaacatggtgacaanaacttangacanagtaacgttcgaggacgacgggtacacgagtacgaacgacggtaacacgtacactcgaacgacacgactacccgtaacacgtagggacgtacgtagacgaccgaggacgtaggacgagtacgacggacgtacgaacggtccgtagtacgttacgngtacgcgaaggacgacgtagtatacgtagtttagtagg

SEQ ID NO: 356175 - DNA, 504 bp, Homo sapiens
  misc_feature: GZ8MTXP02FF3AV.45.78.H01.1.454.CMB.2.raw
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
  modified_base (440)..(440): a, c, t, g, unknown or other
  misc_feature (440)..(440): n is a, c, g, or t
  modified_base (472)..(472): a, c, t, g, unknown or other
  misc_feature (472)..(472): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggctctggatacaccttcaccggctactatatacactgggtgcgacaggcccctggacaagggcttggagtggatggggatggatcaaacctaacaatggngcacaaactntgcacagaagttcagggcagggtcacatgaccagggacacgtccatcagacacacgcctaacagtggacgcgtgacgcgaggcngagatcgagacgacacggctagtactacgtgngcgaagaggacgagagtacgtagtttagtagg

SEQ ID NO: 356176 - DNA, 607 bp, Homo sapiens
  misc_feature: GZ8MTXP02GTMQ7.45.78.H01.1.454.CMB.2.raw
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccggctactatatacactgggtgcgacgaggccccctggaccaagggcttggagtggagtggggataggatccaaaccctaacaatgggtaggactacaaaactgtgacaacagtaacgtttcgaaggggcacgggtacaaccgtagtacgaaccgaggggaaccacggtcccagtacgacgcaaccgacgaccctaaacgacgttggggaacgtcccgtaggaacgccggaggaccgtacggagtaacgtcgtaggaaccgacgaaccggtcccgttaggtaatttacgtcggtagaccggaagagggacaaaggtaacttacggttagtttttaggtaagg

SEQ ID NO: 356177 - DNA, 655 bp, Homo sapiens
  misc_feature: GZ8MTXP02I1BAC.45.78.H01.1.454.CMB.2.raw
  modified_base (273)..(273): a, c, t, g, unknown or other
  misc_feature (273)..(273): n is a, c, g, or t
  modified_base (435)..(435): a, c, t, g, unknown or other
  misc_feature (435)..(435): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatcgganctgagcaggctgagatcgtgacgacgcggtcgtgtattacgtgtgcgaggaggacgaaggtaattacgtagtttttggacgttggtttacgtcggtacggttagtcggggacgttcggtcgggggaccgacggggacctacgggtccacccgtctcctcgcnccctacccgacgaccggccctacgtccgtacctccccgtcggccctacccgtcctaccgacgtaccgcctacccgttcggacgggggaccaacggccggtccgggcccgtcggggtacctcggtccgttcgggtaaccgaacgggttaccctaccgtttcccgtaaacgtccgttaccggcccgtttacggtcggtaccggggcccgggtacgtccgggg

SEQ ID NO: 356178 - DNA, 580 bp, Homo sapiens
  misc_feature: GZ8MTXP02F0VUW.45.78.H01.1.454.CMB.2.raw
  modified_base (380)..(380): a, c, t, g, unknown or other
  misc_feature (380)..(380): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctggaggtgaagagccgtggggcctgagtgaaggtctcctgcaaggtcttcgtggactactaccttcgaccggtactactatactacacgtgggtgcgacgacggccccgtaggacgaagggtctggagtgggatgggatcggataccaaacctaaccagtcggtagacaacaaactncgacaataaggtaagttcgacgggctacggtacaacagacgaacgaggaccacgtccatcacgacaacgacgaccctaagacgtacgggacgtcgagacgacggagcgtagagtactacgagaccacggacggtacgtagttacttagtcgagacggaagacggtacgtaaggtaacgtttaggttaggtttggtaacgg

SEQ ID NO: 356179 - DNA, 503 bp, Homo sapiens
  misc_feature: GZ8MTXP02HN9R2.45.78.H01.1.454.CMB.2.raw
  modified_base (443)..(443): a, c, t, g, unknown or other
  misc_feature (443)..(443): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaaccctaacaatggtggcacgaaactatgcacagagtttcagggcagggtcacatgacagggacacgtcatcagcacacgacctacactggagctgagcgaggctgagagtcngacgacgacggccgtgtatacgtgtgcgaagaggacgaggaatacgtagttttaggtagg

SEQ ID NO: 356180 - DNA, 617 bp, Homo sapiens
  misc_feature: GZ8MTXP02I9HF8.45.78.H01.1.454.CMB.2.raw
  modified_base (253)..(253): a, c, t, g, unknown or other
  misc_feature (253)..(253): n is a, c, g, or t
  modified_base (461)..(461): a, c, t, g, unknown or other
  misc_feature (461)..(461): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagacgccgtgggcctcgagtgaggtctctgcaggtcttcgnggatacaccttcgaccgctactatatacacgtggtgcgacgcggccccgtaggacgaaggtcttaggagttagggagtgggatggactaccgaaacctaagaagtggtaggacaactaaactgcgactaacgaagttaacgttcgagggtacgacgggtaccacgagtacgaaccgagggaccacgtccatcagacagacgactacgngtaggactcgagacgacgaacggtcgtacggaatacgtacgacggaccgaaacggtccgggtaccgttagttaaccgtttaaggtcggtcggaaccgggaagacggtaacgtaaacggttaacgttttaacgtttacggtttttagggttaacggg

SEQ ID NO: 356181 - DNA, 676 bp, Homo sapiens
  misc_feature: GZ8MTXP02JXJ0A.45.78.H01.1.454.CMB.2.raw
  modified_base (274)..(274): a, c, t, g, unknown or other
  misc_feature (274)..(274): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatcgaccagggacacgtccatcagcacagcctacagtggancgtgagcgaggctgagtatcgtgacgacgacggtccgtagtattacgtgtgcgaggaggacgtaggtaattacgtagttttaggagttggtttagtcggtacggtagtcgggtacgtcggtcggggaccgaagggaccgacggtccaccgtcctccgtcacgccctacccgaaccgaacggccctacgttcccggttcccttccccgtcggccctacccctacccgtaccgaaacgtcgaccctaccgtccgggtacgggggccacggccgggtcccggtcccgtcggggtcctccgggtcccgtacggggtaccgaaacggtacccgtttaccgttacccgtacggtaaccgttcccgggtcgttacccggttaggaccggggccggggtacgtaccgggg

SEQ ID NO: 356182 - DNA, 644 bp, Homo sapiens
  misc_feature: GZ8MTXP02GJ369.45.78.H01.1.454.CMB.2.raw
  modified_base (593)..(593): a, c, t, g, unknown or other
  misc_feature (593)..(593): n is a, c, g, or t
tcagacgcgatcgacacgaccggtgctcgatttagtgtgagtagtttgggtttgggggagcatcacccaccaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctctgcaggcttcgtggatacaccttcaccggctactatactacacgtgggtcgcgacgacggccccgtaggaacgaagggtcttaggacggtggagtgggagtggaactaccgaaacccgtaacgaagtgggtacgacaaacgaaacttagtacgaccgacgtaaaggttaaacggtttcgaacggggtacgacggggtaccaaccgtagtaccggaccgaaacggggaccaaccgttaccacgtacgaacgaccaccgtacgtaccctaacgaggtcgggagacgtaggacgtacgaggcgtagagtacgtcgacgaacgacggaccggtccgttagtacttacgtgaccgnggaagaacgagtaacggttaacgttacggttaggtttacggagtttacggg

SEQ ID NO: 356183 - DNA, 538 bp, Homo sapiens
  misc_feature: GZ8MTXP02IOZQU.45.78.H01.1.454.CMB.2.raw
  modified_base (251)..(251): a, c, t, g, unknown or other
  misc_feature (251)..(251): n is a, c, g, or t
  modified_base (289)..(289): a, c, t, g, unknown or other
  misc_feature (289)..(289): n is a, c, g, or t
  modified_base (361)..(361): a, c, t, g, unknown or other
  misc_feature (361)..(361): n is a, c, g, or t
  modified_base (427)..(427): a, c, t, g, unknown or other
  misc_feature (427)..(427): n is a, c, g, or t
  modified_base (444)..(444): a, c, t, g, unknown or other
  misc_feature (444)..(444): n is a, c, g, or t
  modified_base (452)..(452): a, c, t, g, unknown or other
  misc_feature (452)..(452): n is a, c, g, or t
  modified_base (472)..(472): a, c, t, g, unknown or other
  misc_feature (472)..(472): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctctgcaggcttcgnggatacaccttcaccggctactatatacacgtgggtcncgacacggcccctggacaagggtcttagagtggagtgggactggactacaaacctaacaagtgggtgacaanaaaccgtatcgacaacgaagtaagtttcgagggcagggtacacgtagcgacgagggtacacgtcancgagacacacgtccaanagtggacngtagagcgagcgtagagacncgacgacgtacgacggtcgtagtacgttcgtgacgagaagagacgtaagtattacgttagttggag

SEQ ID NO: 356184 - DNA, 621 bp, Homo sapiens
  misc_feature: GZ8MTXP02H0KWB.45.78.H01.1.454.CMB.2.raw
  modified_base (228)..(228): a, c, t, g, unknown or other
  misc_feature (228)..(228): n is a, c, g, or t
  modified_base (371)..(371): a, c, t, g, unknown or other
  misc_feature (371)..(371): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtgggcctnagtgaggtctctgcaaggcttcgtgactacaccttcaccgctactatatacacgtggtgcgacacggcccctggacgaggctgaggtggagtgggatggactaccgaaacctaacaaagtgggtaggaaccaacgaaaacttntcgacgtaaacaacgggttaaagtttccggaacgggggacgtaacggggtccaaccgtagtacggaacccgaaggggaaccacggtcccaagccaacgcaacagaccccgttaagacgtggagcgaggacgaacgggagtacgtagaggtactcgacgaaccgacggtaccggtcgttagttacgttacgcggtcgaggaaggacggtacggtaaaggttaggtttacggtttaggttttaggggttagg

SEQ ID NO: 356185 - DNA, 594 bp, Homo sapiens
  misc_feature: GZ8MTXP02I2OX6.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatgggtggcacaaaactatgcacagaagtttcagggcaggtcaccatgaccaggacacgtccatcagcacagcctacatcggaagctgacgcgaggctgaagatctgaccgacacggccgtgtactatgtgcgagagacgaggtaattacgtatttttgggagttgttagttcggacgttaagtgggactgtacggggacctaaggggccaacgggtccaccgtctcctcacgcctacaccgtacggccacgtccgtccgtcccccgtgcccaccctcccgtaccaacgaccgacctacccgtacgtcggggcaacgcggccggtcccgcggtctcgcccgtggtaccgaacggtaccttaaccgttccacgtaaccgtcgcgtcgtaggcggtccggcgtacgg

SEQ ID NO: 356186 - DNA, 586 bp, Homo sapiens
  misc_feature: GZ8MTXP02HPJVP.45.78.H01.1.454.CMB.2.raw
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
  modified_base (421)..(421): a, c, t, g, unknown or other
  misc_feature (421)..(421): n is a, c, g, or t
  modified_base (570)..(570): a, c, t, g, unknown or other
  misc_feature (570)..(570): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacncggcctgtattacgngtgcgagagcaggtaattacgtagttttaggagttggttagttggtacggtagtggacgtgtggggcccgaaggggtaccacggtccgaccgtccgtccctcacgcccnccctaaccgacgggcccacgtccgtacccttccccgtgcccctacccctcccgtaccacgacgccctaccgtcgcgggggccaacgccgccggcccgtcgggtctcggcccgtcggtacacggtacctacttcctacgcgtcgcgttcncggcgcggtcgtacgg

SEQ ID NO: 356187 - DNA, 628 bp, Homo sapiens
  misc_feature: GZ8MTXP02IP8HL.45.78.H01.1.454.CMB.2.raw
  modified_base (242)..(242): a, c, t, g, unknown or other
  misc_feature (242)..(242): n is a, c, g, or t
  modified_base (245)..(245): a, c, t, g, unknown or other
  misc_feature (245)..(245): n is a, c, g, or t
  modified_base (499)..(499): a, c, t, g, unknown or other
  misc_feature (499)..(499): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctggaggtgaagagcgtgggctgagtgagtctctgcagctngancactcacgctactatatacacgtgggtgcgacgcggccccgtggaacgaaggcttaggaggtggaggtgggatggtaactaccgaaaaccctaagtagtcgggtacgactaaacaaacttagcgacgaaacaaaggttaccgttacggaggggcctaacgggtacaaccgtagacggaaccggaacgggaccacggtccagtacgagaccaacgacgtaaccctagaggtacggacgtacgggagaaccggggnggtacggtagacggaacgtacgtaccgaacggaaccggtacggtaccggtacgttacgttacgtacgtcggtacggagaacggtacggtaacgtaacggttaacgtttacggtttaggtttacggtagg

SEQ ID NO: 356188 - DNA, 670 bp, Homo sapiens
  misc_feature: GZ8MTXP02FXUOD.45.78.H01.1.454.CMB.2.raw
  modified_base (301)..(301): a, c, t, g, unknown or other
  misc_feature (301)..(301): n is a, c, g, or t
  modified_base (603)..(603): a, c, t, g, unknown or other
  misc_feature (603)..(603): n is a, c, g, or t
  modified_base (614)..(614): a, c, t, g, unknown or other
  misc_feature (614)..(614): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcgagtgaaggtctcctgacaaggtcttcgtggactaccaccttcgaccggctaactatactacgacgtgggtcnccgacgacggccccgtggaacgaacgggtcttaggaggtagggagtggggaatgggaataccgaaaccctaaacgaagttcgggtagacctaaactaaacgtatcggacaacgtaaggtaaacgttcgaaggggtcgaacgggtaccacgtagtacggaaccgaacgggaccacggtccaataccgaacgccaacgtacgaccctagagtagggacgacgtagacgacgaacggcgttagaacggtacttacggacggaaccgtaccggacgggtaccgtttagttaaacgttaccgtcggnggaaacccggnggaacggtacgtaaaagggttaactttacgggtttaaagttttcggggttaaaggg

SEQ ID NO: 356189 - DNA, 605 bp, Homo sapiens
  misc_feature: GZ8MTXP02FF12R.45.78.H01.1.454.CMB.2.raw
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggagccccactcccaggtgcagctggtgcagtctggggctgaggtgaagagccgtgggcctcagtgaaggtctcctgcaggtcttctggatacaccttcgaccggctactatatacacgtgggtcgcgacgacggcccctgggaaccaagggctttaggaggtggagtgggatggactaccgaaacccttaaagaagtggggtaggacccaacaaactatacgacacaagtagttcgaggcacggggtacacgatacgaaccgaagggaccaacgtaccataccgacgaccgaacacgtacctaacgacgttaggacgtacgtaggacgacggacggcgtacgagtacgttacgacggaaccgacgacggtccgtagtacttacgtgtcgacgagagacgtaggtaaagttagttacggtttaggagtttacggttagtcgggtaagg

SEQ ID NO: 356190 - DNA, 708 bp, Homo sapiens
  misc_feature: GZ8MTXP02H5CTM.45.78.H01.1.454.CMB.2.raw
  modified_base (267)..(267): a, c, t, g, unknown or other
  misc_feature (267)..(267): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgacacgagtaagtttcgagggcagggtcaccgatcgaccgagggacacgtcatcagcacngacctacagtggagtctaggacgcaaggccgtagacgtatcgtacggacgacgacggtccgttagtacttacgtgtcgacggaggaggactaaggtaacgttacggttagtttttagggacggtttagggttagtttacggggaacggttagtcggggaacggtttcgaccgggggactaaacggggtacccgacggttccgtacccgtacgtcccgtcgaccgcctcccgaaccgaacggtacccacgtccgttaccgttccccgtcggtacccctaccctaccgtaccaacggacgacccgtacgtaccggtcgggggaccaccggtacggccggtccggtcgggtaccgtccgacggtacggtaacggtaacggtaccgtaaccgtttccgtacgtaacgtccgcggtacgtcggaacggttcgggtacgtaccgggg

SEQ ID NO: 356191 - DNA, 624 bp, Homo sapiens
  misc_feature: GZ8MTXP02F6ZVQ.45.78.H01.1.454.CMB.2.raw
  modified_base (586)..(586): a, c, t, g, unknown or other
  misc_feature (586)..(586): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgagctgagatctgacgacacggccgtagtattctgtgcgagaggcaggaattacgtatttttggagttggttacgttcggaacggttagtgggacgttcgtagggggaccgaaggggacccgaaacgggtccaccgtctcctcgacgcccgtacccaccgaacggcccaacgtccggtccttccccgtcggcctacccctctacccgaacgacgcctaaccccgtggtacgggggacacgacgccgggcccgttcggggcttcggcctacggggtacctaaaccgggtacttaccggcctttacccgngttaaccgcggtcccgttggacggtccgggcggtccgg

SEQ ID NO: 356192 - DNA, 583 bp, Homo sapiens
  misc_feature: GZ8MTXP02H9HW3.45.78.H01.1.454.CMB.2.raw
  modified_base (206)..(206): a, c, t, g, unknown or other
  misc_feature (206)..(206): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
  modified_base (420)..(420): a, c, t, g, unknown or other
  misc_feature (420)..(420): n is a, c, g, or t
  modified_base (422)..(422): a, c, t, g, unknown or other
  misc_feature (422)..(422): n is a, c, g, or t
  modified_base (426)..(426): a, c, t, g, unknown or other
  misc_feature (426)..(426): n is a, c, g, or t
  modified_base (440)..(440): a, c, t, g, unknown or other
  misc_feature (440)..(440): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactntgcacagtaagtttcagggcagggtcacatgaccaggacacgtcatcagcacagcctanatgganctgaggcgaggctggaagacgtcagaacgcgacggccgtagtacttagtgtgacgagaggcgtaaggtaacgttagtagttttgggagttgttacgttcggaggttagtcggacgttcgcgggggacaaggggcctagtccaccgtccncncacnccacgacgacgccncgtccgtcctccgtcgccctaccgtacctaccgacgccgtaccgccgtacgggcggaccacgccggtccggtccgtcggctacggtccgtacgtacgtacgtacctaccgtccgcgtcgtcgtcgtcgcgacggcggtacgcg

SEQ ID NO: 356193 - DNA, 578 bp, Homo sapiens
  misc_feature: GZ8MTXP02JTUPX.45.78.H01.1.454.CMB.2.raw
  modified_base (373)..(373): a, c, t, g, unknown or other
  misc_feature (373)..(373): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttcgtggatacaccttcaccggctactatatacacgtgggtgcgacaggcccctaggacgaagggcttggagtggagtgggatggataccaacctaacaagtggtagacaacaaactatgacaanagtaagttcgagggcagggtcacatacgacgaggacacgtcatcgagacacgacgacctaacgagtaggacgtccgtaggacgaccgagggtcgtaggaagtactcgtaggaccggacgtaccgggaccgtagttacgttacgtggttcggacggaacggaggacgaaacgggttatttaaccggtttagttttacgggtaacgg

SEQ ID NO: 356194 - DNA, 685 bp, Homo sapiens
  misc_feature: GZ8MTXP02HY8SR.45.78.H01.1.454.CMB.2.raw
  modified_base (191)..(191): a, c, t, g, unknown or other
  misc_feature (191)..(191): n is a, c, g, or t
  modified_base (224)..(224): a, c, t, g, unknown or other
  misc_feature (224)..(224): n is a, c, g, or t
  modified_base (242)..(242): a, c, t, g, unknown or other
  misc_feature (242)..(242): n is a, c, g, or t
  modified_base (357)..(357): a, c, t, g, unknown or other
  misc_feature (357)..(357): n is a, c, g, or t
  modified_base (520)..(520): a, c, t, g, unknown or other
  misc_feature (520)..(520): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggaactggaggatcctcttcttggtggcagcagccacaggagcccactcccaggtgcagctggtncagtctggggctgaggtgaagagcgtgggcctnagtgagtctctgcagctngactcacctcacgctactatatactacgtggtgaccgacacggtccccgtaggaacaaggggtcttaggaggtgggtagttggggattcgggaacttaccgaaaaccccgtaaanaaacgttcggggtacggaaccaaactaaaacgtaacgtcggaacaaacgtaaggttaaacggttttcggaagggacgtacgggggtaccaaccgtacgtacggaaaccgacggggtacccgtaccgtacccaatccgaaggaccaacgacggttacccctaanagttaaggggacgtacgtaggacgacgaggtcgtacggagtacgtacgtacgtacggtacgtaccggtaccgttacgttaacgttacgttacgtacggacggtaacggtacggtaacggtaaacggttaaaggtttaacggtttaacggttttacggtttaacgg

SEQ ID NO: 356195 - DNA, 572 bp, Homo sapiens
  misc_feature: GZ8MTXP02IZPZD.45.78.H01.1.454.CMB.2.raw
  modified_base (400)..(400): a, c, t, g, unknown or other
  misc_feature (400)..(400): n is a, c, g, or t
  modified_base (408)..(408): a, c, t, g, unknown or other
  misc_feature (408)..(408): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagtaagtttcgagggcagggtcaccatgacaggacacgtccatcagcacagcctacatggagctgagcgagcgtagagactcgtagacgacgacgccgtagtagttactgtgcgagacggagaggtaatacgtagtttgagtagtagtcgagtatggacgtgtcgggaccgaggaccgagtccaccgtcnctcgaccnccacgacgacgcctcgtccgtcctcccgcgtccctaccctaccgtaccgaacgaccgaccgtaccgtcggcggacacggccgccgcgcggtcgtacggccgtacgtacgtaacgtccttaccgtccgtacgtaacgtcgtacgtcgtaggccggtcggacggcg

SEQ ID NO: 356196 - DNA, 575 bp, Homo sapiens
  misc_feature: GZ8MTXP02ILB6S.45.78.H01.1.454.CMB.2.raw
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (266)..(266): a, c, t, g, unknown or other
  misc_feature (266)..(266): n is a, c, g, or t
  modified_base (352)..(352): a, c, t, g, unknown or other
  misc_feature (352)..(352): n is a, c, g, or t
  modified_base (469)..(469): a, c, t, g, unknown or other
  misc_feature (469)..(469): n is a, c, g, or t
tcagacgcgatcgacacgaccggtgctcgatttagtgtgagtagtttgggtttggggagcatcgcccagcaaccacatctgtcctctagagaatcccctgagagctccgttcctcaccatggactggacctggaggatcctcttcttggtggcagcagccacgaggacgcccactcccaggtgcagctggtgcagtcgtgggctgaggtgaagagcgtggctgagtgagtctctgcagtctngatacactcacgntatatactacncgtggtgacgacgacggcccgtaggacgaaggtcttaggagtggagtgggatgactaacaacctagagtggagacaaactaaactntcgacaagtagtaagttcgagggactacgggacacgagtacgaaccgaggaacctacgtacatacgacgacacgacgtacctacgagtagacgtacgtagagtcgaggtcgtagaancgtacgtacgaacgacggtaccggtacgttaagttacgtacgtaggtacgaaggtaacggaggtaacggtaacgttaagtttacgtttaaggtttagggttaacgg

SEQ ID NO: 356197 - DNA, 594 bp, Homo sapiens
  misc_feature: GZ8MTXP02HM04B.45.78.H01.1.454.CMB.2.raw
  modified_base (317)..(317): a, c, t, g, unknown or other
  misc_feature (317)..(317): n is a, c, g, or t
  modified_base (563)..(563): a, c, t, g, unknown or other
  misc_feature (563)..(563): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcaacagaagtttcagggcagggtcaccatgaccagggacacgtccatccagcacagccctacatggagctgagcgaggctgagatctagacgacacggccgtgtatacngtgcgagaggacaggtaattacgtagtttttggagttggttattcggacggttatgggacgtcgtcggggaccgtaagggaccacggtccaccgtctccctcacgccctcccgaccgacgggcccacgtcccggtccttcccccgtacggccctacccctccctaccgaagaccgaccgaccgtcggcggggcacgacgccggccgtcggctcggtccgtcggtaccgaacggtacctcgttaccncggtctcggtcgtcgtagcggcggtcgtcgg

SEQ ID NO: 356198 - DNA, 568 bp, Homo sapiens
  misc_feature: GZ8MTXP02G5HXK.45.78.H01.1.454.CMB.2.raw
  modified_base (249)..(249): a, c, t, g, unknown or other
  misc_feature (249)..(249): n is a, c, g, or t
  modified_base (255)..(255): a, c, t, g, unknown or other
  misc_feature (255)..(255): n is a, c, g, or t
  modified_base (279)..(279): a, c, t, g, unknown or other
  misc_feature (279)..(279): n is a, c, g, or t
  modified_base (284)..(284): a, c, t, g, unknown or other
  misc_feature (284)..(284): n is a, c, g, or t
  modified_base (307)..(307): a, c, t, g, unknown or other
  misc_feature (307)..(307): n is a, c, g, or t
  modified_base (338)..(338): a, c, t, g, unknown or other
  misc_feature (338)..(338): n is a, c, g, or t
  modified_base (433)..(433): a, c, t, g, unknown or other
  misc_feature (433)..(433): n is a, c, g, or t
  modified_base (440)..(440): a, c, t, g, unknown or other
  misc_feature (440)..(440): n is a, c, g, or t
  modified_base (459)..(459): a, c, t, g, unknown or other
  misc_feature (459)..(459): n is a, c, g, or t
  modified_base (475)..(475): a, c, t, g, unknown or other
  misc_feature (475)..(475): n is a, c, g, or t
  modified_base (481)..(481): a, c, t, g, unknown or other
  misc_feature (481)..(481): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcagctcngatacncttcacgctatatatacactggtncgacncggcccctggacaagggctaggngtgggagtggggtcgataccgaaaccctaanacgtgggtagacaacgaaactatgacacaaggtaacttcgaggggactacgggtaccaaccagtacgaacccgagggtaccacgtccatcgaacncgtaacncggtacagacttggggacngtcgaagccgaggtcngagacngacgacgacgtacgtcgtagtacgtacgcgacgacggagaacggtacgtaaaggttacgttaggtttagtttacgggtagtttacgg

SEQ ID NO: 356199 - DNA, 576 bp, Homo sapiens
  misc_feature: GZ8MTXP02GZ3GL.45.78.H01.1.454.CMB.2.raw
  modified_base (228)..(228): a, c, t, g, unknown or other
  misc_feature (228)..(228): n is a, c, g, or t
  modified_base (231)..(231): a, c, t, g, unknown or other
  misc_feature (231)..(231): n is a, c, g, or t
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (362)..(362): a, c, t, g, unknown or other
  misc_feature (362)..(362): n is a, c, g, or t
  modified_base (406)..(406): a, c, t, g, unknown or other
  misc_feature (406)..(406): n is a, c, g, or t
  modified_base (431)..(431): a, c, t, g, unknown or other
  misc_feature (431)..(431): n is a, c, g, or t
  modified_base (454)..(454): a, c, t, g, unknown or other
  misc_feature (454)..(454): n is a, c, g, or t
  modified_base (471)..(471): a, c, t, g, unknown or other
  misc_feature (471)..(471): n is a, c, g, or t
  modified_base (515)..(515): a, c, t, g, unknown or other
  misc_feature (515)..(515): n is a, c, g, or t
  modified_base (531)..(531): a, c, t, g, unknown or other
  misc_feature (531)..(531): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctggaggtgaagaagccgtgggcctnagngagtctcngcaggctntgatacaccttcgacgctactatatacacgtggtcgcgacacggcccctaggaacgaaggtcttaggaggtgggagtgggataggactaccaaacctaacagtggtacgactaanaactagcgacaacgagtaacgttcgagggacagggtaccacgangaaccgagggacacgtacatacganacacacgtccaacaggtagacgngtagacgacgaggtacngacgtagtcagggaccgtacggccggtacgtacgttattaccgnggtacgacggaacggngtaacggacggttaaacgtttaacggtttaggttttaggtaacgg

SEQ ID NO: 356200 - DNA, 700 bp, Homo sapiens
  misc_feature: GZ8MTXP02GX4OD.45.78.H01.1.454.CMB.2.raw
  modified_base (250)..(250): a, c, t, g, unknown or other
  misc_feature (250)..(250): n is a, c, g, or t
tcagacgcgatcgacacgaccggtgctcgatttagtgtgagtagtttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtacaaagcctctatacgaggataggaaacnctcacttagtaattggttacaacgagaggaccgaggaccaatcctaccgaaggcgtaaccttaaatttaagtaacggtttactaaaccgggtactcggtcggggtacccaagacgtaagtattcgacggcggacgtaggtggggtacaggctaatgtctttacaactacgtaagtaaaacgtttgggaaggggtaggaggtacgtaggaggtagttaggttaggttaagttttatttcgtaggtactagtagtacgtaaacggtactaacgtacgtacgggtacccgttaacgtttacggtttacggaccggtaacgggggtaaaccaacggtacgtaaagggtaaaaccgtaacgaaaacggtaaacgttacggtacgtacgtacggaccaaccgttacgtaacgtttcggtacctttactaccgtttcccgtttacccgtaccttacg

SEQ ID NO: 356201 - DNA, 671 bp, Homo sapiens
  misc_feature: GZ8MTXP02IXHMP.45.78.H01.1.454.CMB.2.raw
  modified_base (137)..(137): a, c, t, g, unknown or other
  misc_feature (137)..(137): n is a, c, g, or t
  modified_base (188)..(188): a, c, t, g, unknown or other
  misc_feature (188)..(188): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtncgacaggcccctggacaagggcttgagtggatgggatggatcaaccctaanaatggtggcacaaactatgcacagaagtttcagggcagggtcaccatgacagggacacgtccatcagcacagcctacatggagctgagcaggctgagatctgacgacgacggtccgtgtattactgtgcgagaggcaaggtaattacgtagtttttggagttggttaagttcggaacggttgtcggggtacgttcggtacgggggtaccgaacggggaccgtacgggtccctacccggtcctacccgtccgaacgacccgtacccgaacccgaaccgggtccctaacggtccggttccccttcccccgtacgccccgtaccccctcctacccaacgtacgcccacccgtcgtcggggctacgacggccggtcccgtcgggtcctacggtcccgttagggtaccgtaaacggtaccttacccgttcccgtacggaacgttcccggtacgttacccggtagggtaccgggtccgggtacggtcgg

SEQ ID NO: 356202 - DNA, 745 bp, Homo sapiens
  misc_feature: GZ8MTXP02FUSCL.45.78.H01.1.454.CMB.2.raw
  modified_base (254)..(254): a, c, t, g, unknown or other
  misc_feature (254)..(254): n is a, c, g, or t
  modified_base (298)..(298): a, c, t, g, unknown or other
  misc_feature (298)..(298): n is a, c, g, or t
  modified_base (351)..(351): a, c, t, g, unknown or other
  misc_feature (351)..(351): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaagagccgtgggcctcgagtgaaggtctcctgcgaaggtcttcgnggatacacccttcaccggctaactatactacacgtggtgcgacncggcccctaggacgaagggtcttaggagtggagtgggatggatcaaacctaanagtggagacactaaactagtcgacaaacgtagtaaacgtttcgaacggggaccgtaaggggttacccaaaccgtagttaaccggaaaccggtacggggtaaacccgtaacgtcccgtaaactaccgaacggaccgaaaccgtaaccggtaacccttaaccggaacggttacggggaacggttacccggtaaggaaacgggccgaacgggggacgttaacggaaggtaacgttaccgtaaccggggtaaaaccggacccggtaaaccggggttacccggtttaggttaacgtttaaccgttcggggtacggtaaccggggaaaggaacggggtaacggtaaaacggggtttaaggttttaaccgggtttaacgggtttttagggtttaaaggggg

SEQ ID NO: 356203 - DNA, 777 bp, Homo sapiens
  misc_feature: GZ8MTXP02GMIS2.45.78.H01.1.454.CMB.2.raw
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacntgganctgacgcaggctgagatcgtgacgacgacggccgtagtacttacgtgtcggacgagacggacgtaaggtaaactttacgttagtttttgggagttggttacgttcgggacgttagtgggtacgtcggtacgggggaccaacggggacctacgggtccctaacccgttcctacccgtcgacgtccctacccgaaccgaaccggggccccctacgttcccggtaccccgttcccccgtacgggtaccccctacccccgtttacccgaacccgaaacggtacccgtaccccgtaacccggttccggggtacgggggaacccctaaaccggtacccggggccccgggtacccccgggttcgggggtcccgttacccggggttcccggtttaaccggggaaccgttaaacccgggttacccctttaaccggtttcccccgtaggtaaccgttcccgggtaaccggttccggttaacccggggtcgggccggggttaaccggtaccggggg

SEQ ID NO: 356204 - DNA, 639 bp, Homo sapiens
  misc_feature: GZ8MTXP02JAC29.45.78.H01.1.454.CMB.2.raw
  modified_base (251)..(251): a, c, t, g, unknown or other
  misc_feature (251)..(251): n is a, c, g, or t
  modified_base (519)..(519): a, c, t, g, unknown or other
  misc_feature (519)..(519): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctgagtgaaggtctcgtgacaaggtcttntggatactaccttcaccggctactataataccgacgtggtgcgtacgacggccccgtggaacgaaggcttggaggtgggagtcgggtatcggactaccgtaaaccctaaacgaaacgtgggtacggaccaacgtaaaactacgtaggaccaaacgtaaaggtaacgtttacgaacggggacacggggttaccaaccgtagtacgaaccgaagggacctacgtaccgatccgaagccaacacggacctacaggtgagcgagacgcgagntaggagtacgtcgaggaccgacggtaccggacgttaggtaacctttacgggtacggtacggacggaacggtaacggtacggtaaaggttaacgtttacggtttacggttttacggtacgg

SEQ ID NO: 356205 - DNA, 577 bp, Homo sapiens
  misc_feature: GZ8MTXP02IYVSH.45.78.H01.1.454.CMB.2.raw
  modified_base (226)..(226): a, c, t, g, unknown or other
  misc_feature (226)..(226): n is a, c, g, or t
  modified_base (251)..(251): a, c, t, g, unknown or other
  misc_feature (251)..(251): n is a, c, g, or t
  modified_base (339)..(339): a, c, t, g, unknown or other
  misc_feature (339)..(339): n is a, c, g, or t
  modified_base (358)..(358): a, c, t, g, unknown or other
  misc_feature (358)..(358): n is a, c, g, or t
  modified_base (422)..(422): a, c, t, g, unknown or other
  misc_feature (422)..(422): n is a, c, g, or t
  modified_base (435)..(435): a, c, t, g, unknown or other
  misc_feature (435)..(435): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagcctggggcctnagtgaaggtctcctgcaaggcttcnggactacaccttcaccggctactatatacacgtggtgcgacacggccctggacaaggtctggagtggatgggatggatacaaccctanagtggtgactacaaacttngacaacagtaacgttcgaaggggctacgggtacaccagtacgaccgaggaccacgtccatcganacacacgcctaanaagtcggagcgtacgagaccgaggtcgtaggagtaacgtcgaggtaaccgacgtaacccggggtccgttagttacgttacgtcggtacggacgtaagggacgacgtaaggtaactttacggttacggttttagggttaaggg

SEQ ID NO: 356206 - DNA, 559 bp, Homo sapiens
  misc_feature: GZ8MTXP02I3RZY.45.78.H01.1.454.CMB.2.raw
  modified_base (248)..(248): a, c, t, g, unknown or other
  misc_feature (248)..(248): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (264)..(264): a, c, t, g, unknown or other
  misc_feature (264)..(264): n is a, c, g, or t
  modified_base (279)..(279): a, c, t, g, unknown or other
  misc_feature (279)..(279): n is a, c, g, or t
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
  modified_base (438)..(438): a, c, t, g, unknown or other
  misc_feature (438)..(438): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcagtgaagtctctgcaggctnganacnctcacgctanatatacacgtgggtncgacaggcccctggaccaaggctgagtggagtggatggatacgaacctanaacgtggtgacacaaactntcgcaacgtagtaaacgtttcgaacgggtcgagggtcaacgagtacgaccgaggacacgtaccatcacgcacacgcctacgacgtggacncgttagacgacgacggtcgtaggacgaagtcgtacgaaccggacgtaccgggaccgttagtacgttacgtggtaggacgaaggacggacgtacggtaagttacggtagttttacggtaagg

SEQ ID NO: 356207 - DNA, 531 bp, Homo sapiens
  misc_feature: GZ8MTXP02F48NH.45.78.H01.1.454.CMB.2.raw
  modified_base (260)..(260): a, c, t, g, unknown or other
  misc_feature (260)..(260): n is a, c, g, or t
  modified_base (295)..(295): a, c, t, g, unknown or other
  misc_feature (295)..(295): n is a, c, g, or t
  modified_base (432)..(432): a, c, t, g, unknown or other
  misc_feature (432)..(432): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggataccnccttcaccggctactatatacacgtgggtgcgacncggcccctaggacgaagggtcttggagtggatagggatggataccaaacctaacaagtggagacaacgaaactgtgacatagtaagttcgagggcagggtcacgagtgacgaggacacgtcatcagacacagcctanagtgagcgtgagcgagtcgaggagatcgacgacggacacggtactaggtacctacgtcgagacgaaggacgcgtaacggtatacgtagtttaggtacgg

SEQ ID NO: 356208 - DNA, 601 bp, Homo sapiens
  misc_feature: GZ8MTXP02FP4YJ.45.78.H01.1.454.CMB.2.raw
  modified_base (314)..(314): a, c, t, g, unknown or other
  misc_feature (314)..(314): n is a, c, g, or t
  modified_base (457)..(457): a, c, t, g, unknown or other
  misc_feature (457)..(457): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctagagatcgtgacgacacggccgtgtattacngtgcgagaggcaggaattacgagttttggagtgttatcggacggtgtggacgtcgtggggacctaagggaccgacggtccaccgtctcctcacgcctaccgacacgggccacgtcggtaccttccccgtggccacccctaccnccaagaccggaccacccgtcgtacgggggcacgacggcgggcccctgggggtcctcggccgtacgggttaccgaaacggtaccgttaccgttcccgtacgaaccgttccggcgttccggtggaacggtccggggcgtaacgggg

SEQ ID NO: 356209 - DNA, 605 bp, Homo sapiens
  misc_feature: GZ8MTXP02GFVU9.45.78.H01.1.454.CMB.2.raw
  modified_base (454)..(454): a, c, t, g, unknown or other
  misc_feature (454)..(454): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcacatgacagggacacgtccatcagcacagcctacatggagctgagcgaggctgagaatctgacgacaacggccgtgtattacgtgtgcgagaggcaaggaaattacgatttttggagtggttattcggaacggtatgggacgtcgtggggccaaggggaccacgggtcaccgtctacctcacgcctccaaccaacggggccccaagtccgtacccttcccccgnggcccaccctcctcccaaagacggaccctaacccgcgtcgggggacacgacgccggccccgtggggcttcggcctttacggggactaaaacgggaccttaaaccttcccgttacgaacgttcccgcgttccgagtaggccggggcctaggg

SEQ ID NO: 356210 - DNA, 730 bp, Homo sapiens
  misc_feature: GZ8MTXP02HN37C.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcgaggctgagatctgacgacacggccgtgtattacgtgtgcgagagggacgtaaggtaaacgtttaacggtagttttttaggggaggtttgggtttaacgtttacggggtaaccggggttaagtcgggggtaaccgggtttccgggtacggggggtacccgaaaacgggggtaaccccgtaaaccggggtcccgaaaccccggttccctaccccgttacccgaacggtcccctaccccgaacccgaaaccggggccccctaacgttcccgggttacccttccccccgtacgggccccctacccccgtcccgttaccaacggaccgaccctacccgtcggtcgggggcacggacgcccggtcccgtcgggccgtcggcccgtacgggttaccgaacggtacctaccgttcccgtacgtaacgtccgcgtcgtacggacggtcgggtcgtacggg

SEQ ID NO: 356211 - DNA, 561 bp, Homo sapiens
  misc_feature: GZ8MTXP02IAHN9.45.78.H01.1.454.CMB.2.raw
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
  modified_base (454)..(454): a, c, t, g, unknown or other
  misc_feature (454)..(454): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctggaggtgaagaagccgtggggcctcgagtgaagtcctctgcaaggtcttcgtgactacaccttcgaccggtctactatatacacgtggtgcgacacggcccctggacgaagggtcttggagtggagtcggatggactaccaacctaacgagtggtacggacaacaaatntcgacanaggtaagttcgagggtcacgggtacacgagtacgaccgacgggacacgtccatcgacgcacacgcctacagtganctagcgacgagtcgagagacgtcgacggaccgacggaccggtaccgttgttacgttacgcgtcgacgtaaggacgagtacggtagttacggtttatttagggtaagg

SEQ ID NO: 356212 - DNA, 571 bp, Homo sapiens
  misc_feature: GZ8MTXP02F1REJ.45.78.H01.1.454.CMB.2.raw
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtatactgtgcgagagcaggaattacgattttggagtgttatcggacggtagtgggacgtcgtggggaccaggggaccgacggtcaccgtctacctcacgcctccaccgaggcccacgtccgtaccttcccccgtggcccacccgttcccaccaacgacgacctacccgtcgtacgggggccacgtaccgcggtcccgtcgggctcggccttcgggacaacggtacctacgtcctacggaactcgcgtaccgtgcggcggcgtcggg

SEQ ID NO: 356213 - DNA, 582 bp, Homo sapiens
  misc_feature: GZ8MTXP02JI7NX.45.78.H01.1.454.CMB.2.raw
  modified_base (251)..(251): a, c, t, g, unknown or other
  misc_feature (251)..(251): n is a, c, g, or t
  modified_base (372)..(372): a, c, t, g, unknown or other
  misc_feature (372)..(372): n is a, c, g, or t
  modified_base (457)..(457): a, c, t, g, unknown or other
  misc_feature (457)..(457): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctgagtgaaggtctctgcaggcttnggatacaccttcgaccggctactatatacacgtgggtgcgacgacggcccctggacgaagggtcttaggaggtggagtgggatggactaccaacctaacaagtggtacgacaacgaaactntgacaacgagtaagttcgagggacgagggtcacgagtacgacgaggacacgtacactcgagcacacgtaccctagacgtaggacncgtacgacgcgaggactagacgtatcgacggaacgacgtacggtccgtagttaacgttcgtcggtacgacggtaacggacggtacgtaaggggttaactttacggtttacggtttagggttaagg

SEQ ID NO: 356214 - DNA, 645 bp, Homo sapiens
  misc_feature: GZ8MTXP02FZO7W.45.78.H01.1.454.CMB.2.raw
  modified_base (273)..(273): a, c, t, g, unknown or other
  misc_feature (273)..(273): n is a, c, g, or t
  modified_base (275)..(275): a, c, t, g, unknown or other
  misc_feature (275)..(275): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggacacaaactatgcacagaagtttcagggcagggtcaccatgaccgaggacacgtccatcagcacagcctacatggancngagcaggctagagatcgtagacgacgacggccgtagtacttacgtgtgcgaggacggcgaggtaaacttagtagtttttagggagtttggttagttacggggtaacggttagtggggtaccgtcgtcgggggtaccaaacggggtaccgtacgggtcctaacccgtctaccctcgacgtcccaccgaccgacgggccctacgtcccgtacccttccccgtcggaccctaccctacccgtaccaacgaccgacctaccccgtcgtcgggggaccaacggccggccggtcccgtcggggtccgtacggccgtcggtaacgacggtaccttacctcgtacgaacgtcgcgttacgcggacgcgggactacggg

SEQ ID NO: 356215 - DNA, 633 bp, Homo sapiens
  misc_feature: GZ8MTXP02IMZU9.45.78.H01.1.454.CMB.2.raw
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
tcagacgcgatcgacacgaccggtgctcgatttagtgtgagtagtttgggtttgggggagcatcacccagcaaccacatctgtcctctagagaatcccctgagagctccgttccctcaccatggactggacctggaggatcctcttcttgggtggcagcagccacaggagcccactcccaggtgcagctggtgcagtcgtggggctggaggtgaagagccgtgggcctgagtgaaggtctctgcaggcttgngatacnctcacgctactatatacacgtgggtgccgacgaccggccccgtaggacgaaggggtcttaggaggtgggagtggggatagggtactaaccgaaacccgtaaagtaggtacgggtacggacaaacgtaaaacgtagtcggacaaacgtaaggttaacgtttacggagggacgacgggtacaacacgtacgaccgacggaccgacgtaccagacacgaccaacgacgacctaacgagtaggagtcgagacgacgacggcgtaggagtacgtcgaacggaccgaccggaccgggtacgttacgttacgttaccgtacggtggacgaagggacggaacggtaaggttaagtttaacggtttaggtttttagggtaaggg

SEQ ID NO: 356216 - DNA, 637 bp, Homo sapiens
  misc_feature: GZ8MTXP02FUZT8.45.78.H01.1.454.CMB.2.raw
  modified_base (516)..(516): a, c, t, g, unknown or other
  misc_feature (516)..(516): n is a, c, g, or t
  modified_base (536)..(536): a, c, t, g, unknown or other
  misc_feature (536)..(536): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggaggatcctcttcttggtggcagcagccacaggacgcccactcccgaggtgcagctggtgcagtcgtggggctggaggtagaaggagccgtggggcctcgaggtgaaggtcctcgtgacgaaggtcttgtaggactacctacccgttcgaccggtactactatactacacggtggtacgacgaccgacggtccccgtaggaacgagggtctggacgtggagtaggggatagggactacctaaacccgtaaataggtcgggtacggaaccaaaccgtaaaactagtacgaacaacgaaggtttacggttacgaggggaccgtaacgggtccaacgagtcgaaccgaagggaccacgtccaatacacgcaacgtcgacctacgagtacggancgagacgcgaggtcaggaancgtcgtaacgacgtaacgcgggtcttaggtataccgtggtagacgagtacgagtaaggtaacgttaggttagttaggtaggtttagtacggtacggtaagg

SEQ ID NO: 356217 - DNA, 584 bp, Homo sapiens
  misc_feature: GZ8MTXP02F7ZC6.45.78.H01.1.454.CMB.2.raw
  modified_base (328)..(328): a, c, t, g, unknown or other
  misc_feature (328)..(328): n is a, c, g, or t
  modified_base (404)..(404): a, c, t, g, unknown or other
  misc_feature (404)..(404): n is a, c, g, or t
  modified_base (419)..(419): a, c, t, g, unknown or other
  misc_feature (419)..(419): n is a, c, g, or t
  modified_base (451)..(451): a, c, t, g, unknown or other
  misc_feature (451)..(451): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcacatgaccagggacacgtccatcagcacacgacctacagtggagctggagacgaggctaggacgtatcaggacgaccgacggccgttagtattcgtgnggacgagaggacaaggtaaatttacgtagttttggagttgttagttcggagtatgggcgtgcgggaccgagggacncgcaccgcctcctcncgcctccgacacggccacgtcgtaccctcccncggacccaccctccctaccgacgtacgccacccgtcggtcgggaccacgcggccggtccgcggcgtcgccgtcgacgacgtaccttactcccgtacgaacgtccgtacgtcgtacggacggccggtcgtacgg

SEQ ID NO: 356218 - DNA, 707 bp, Homo sapiens
  misc_feature: GZ8MTXP02GXHYD.45.78.H01.1.454.CMB.2.raw
  modified_base (693)..(695): a, c, t, g, unknown or other
  misc_feature (693)..(695): n is a, c, g, or t
  modified_base (697)..(697): a, c, t, g, unknown or other
  misc_feature (697)..(697): n is a, c, g, or t
  modified_base (701)..(702): a, c, t, g, unknown or other
  misc_feature (701)..(702): n is a, c, g, or t
  modified_base (704)..(705): a, c, t, g, unknown or other
  misc_feature (704)..(705): n is a, c, g, or t
  modified_base (707)..(707): a, c, t, g, unknown or other
  misc_feature (707)..(707): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtagaagaagccgtggggcctcgagtagagtctccgtgcgaaggtcttgtggactacaccttcaccggtctactatactacgacgttgggtgaccgacgaccgggccccgtagggaacgtaacgggtcgttgggaaggtgggtaggttaggggaacgtagggtaaccttaaacccgtaaacccgtaaaaccgtaacgggttagggtacgggtaacctaaaacggtaaaacttacgttacggaccaaaaggtaacgttaaaccgggtttacgggaacggggacggtaaccgggggtaccaaaccgtaacggaacggaaacccgggaacgggaacccgtaacccgttaccgaacgtaccgaacggaccaaaccgtacgtaccctaaaggtacggtagggtaccgtacggtacgggaaccgggccgggtacgggtacgggaacggaacggggttccgaacgtaaggtaaggcgacgcacgacgacgcgnnngngagnngnnan

SEQ ID NO: 356219 - DNA, 620 bp, Homo sapiens
  misc_feature: GZ8MTXP02HK1AV.45.78.H01.1.454.CMB.2.raw
  modified_base (252)..(252): a, c, t, g, unknown or other
  misc_feature (252)..(252): n is a, c, g, or t
  modified_base (261)..(261): a, c, t, g, unknown or other
  misc_feature (261)..(261): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctggaggtagaagaacgccgtgggcctcgagtgagtctctgcaggcttgnggactaccnccttcgaccgctactatactacacgtggtgcgaccgcggccccgtaggaccgaaggtcttaggaggtggagtgggataggactaccaaaccgtacgagtggcgacaacgaatgtcgcaaagtagttacgttacgagggacgtacggtaccacacgtacgacgacggacctacggaccacgtacgacgacaacgacgtaccctagacggtaggacgcgtacggagtaccggaggacgtaggacgtagtaccgacgaaaccggccggacggttaaccgtgttaaacggttccgtagggtacgacggaaggtacgaacggtaaggtttaacgtttacgggtttaggttttacggggtaaggg

SEQ ID NO: 356220 - DNA, 568 bp, Homo sapiens
  misc_feature: GZ8MTXP02I54XD.45.78.H01.1.454.CMB.2.raw
  modified_base (254)..(254): a, c, t, g, unknown or other
  misc_feature (254)..(254): n is a, c, g, or t
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctctgcagctctgatacncctcacgctactatatacactgggtgcgacgacggcccctaggacgaagggtctggagtggatgggatggactacgaaccctaacgaagtcggtgacaactaaacgttatgacactaaagtagtttacgagggcgtaacgggtacacgtagtacgaaccgagggaaccacggttaccacgccaagcacgacgaacctaccaggttagacgcgtaaggcgacggaacggtcgaggtagacgtacgtcgacggtacgcggtaccgtagttactcgagtcgagaagacgtagaacgtagttacgtagtttagtaggg

SEQ ID NO: 356221 - DNA, 658 bp, Homo sapiens
  misc_feature: GZ8MTXP02J2Z2Q.45.78.H01.1.454.CMB.2.raw
  modified_base (161)..(161): a, c, t, g, unknown or other
  misc_feature (161)..(161): n is a, c, g, or t
  modified_base (399)..(399): a, c, t, g, unknown or other
  misc_feature (399)..(399): n is a, c, g, or t
tcagacgcgatcgacacgaccggtgctcgatttagtgtgagtagtttgggtttggggacccagcaaccacatctgtcctctagagaatcccctgagagctccgttcctcaccatggactggacctggagatcctcttcttggtggcagcagccacaggacncccactcccaggtgcagctggtgcagtcgtggggctggaggtagaagacgccgtggggcctcgagtgaacggtcctccgtgaccgaaggtcttcgtggactacctacccttcgaccggtctaactatataccacgtgggtacgcgaccgacgggcccctaggacgaaggggtctttaggaggtggacgtgggtagtggactaccgaaacctaacgagtcggtcgaacctaactaaacngtacgactaacgtagtacggtttcgaacgggtacgaggggtacccacgtacgtcggaacccgtagggacccacgtaccgactcgacgccaaacgtacgtaccgtacgagtgggaaacgccgtaggacgacgacggtactagagtacgtacgcggaaccgtacgcggtacgtagttagttacggcggtacgacggacgacgtagtaacggttaacgttaacggtttaggttacggttaggttacggttacggtacggtag

SEQ ID NO: 356222 - DNA, 675 bp, Homo sapiens
  misc_feature: GZ8MTXP02I60A9.45.78.H01.1.454.CMB.2.raw
  modified_base (226)..(226): a, c, t, g, unknown or other
  misc_feature (226)..(226): n is a, c, g, or t
  modified_base (249)..(249): a, c, t, g, unknown or other
  misc_feature (249)..(249): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagcgtgggcctngtgaggtctcctgcaggcttcgnggataccaccttcaccggctactatatacacgtgggtgcgacgcggcccctaggacaaggggtcttggaggtggagtgggatggactaccaacctaacgagttggagacacaaaactgtcgacaacgtagtaaacgttcgaacggggtacgaggggtaccaaacgtacgtacggaaccggaaacggggaacctaccggtacccaactcccgaaaggaccaaccaacggtaccccttaaagaacggttgggacccgtacgggttaggaacggtaccgggtaaggtccggtaaggaagtaacgttccggaacggaaccggaccggtaaaccgggtccgttaaaggttacttacgttcgggaggacgaaacggggtaggaccgttaaaacgggttaacgtttaacgggtttaggttttagggttaaggg

SEQ ID NO: 356223 - DNA, 672 bp, Homo sapiens
  misc_feature: GZ8MTXP02FW9US.45.78.H01.1.454.CMB.2.raw
  modified_base (272)..(272): a, c, t, g, unknown or other
  misc_feature (272)..(272): n is a, c, g, or t
  modified_base (320)..(320): a, c, t, g, unknown or other
  misc_feature (320)..(320): n is a, c, g, or t
  modified_base (326)..(326): a, c, t, g, unknown or other
  misc_feature (326)..(326): n is a, c, g, or t
  modified_base (406)..(406): a, c, t, g, unknown or other
  misc_feature (406)..(406): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaacctaacaatggtggcacaaactatgcacagaagtttcagggcagggtcaccatgaccagggacacgtccatcagcacagccctacatgganctagagcgaggctgagatcgtagacgtacgacggtccgtagtattacnggtcgngaggagcaaggtaattacgtagttttggagttgttagttcggacggttatggggactggtgggacgtaacggacgcgtcnccgtctcctcagccctcgacgaccggccctacgtccggttaccctacccccgtggaccccaacccttcccgtaccaacggaccgccgaaccccgtttcgggacgggggacctaaacgccggggtaacccggtccccgggtcggtccgttaaccggtccgttacgggggtaacctaaccggggtacctttaacccgtcccggttaacgtaaccgtttaccgggccttacgggttaccgtacgggacccggggttcgtaacccggggg

SEQ ID NO: 356224 - DNA, 631 bp, Homo sapiens
  misc_feature: GZ8MTXP02FGPA4.45.78.H01.1.454.CMB.2.raw
  modified_base (256)..(256): a, c, t, g, unknown or other
  misc_feature (256)..(256): n is a, c, g, or t
  modified_base (276)..(276): a, c, t, g, unknown or other
  misc_feature (276)..(276): n is a, c, g, or t
  modified_base (319)..(319): a, c, t, g, unknown or other
  misc_feature (319)..(319): n is a, c, g, or t
  modified_base (617)..(617): a, c, t, g, unknown or other
  misc_feature (617)..(617): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatccaaccctaacaatgggtggcaacaaactatgcacagaagtttcgagggcagggtcacatcgaccagggacacgtcancagcacacgcctacatgganctagagcgaggctaggagtatctacggacgacgaccggcgttntaacttacgtggtgcggaagggtaacggacgaaaggtaaacgtttacggttaagtttttcggggaagttgggtttaacgttcggggaacggttagtcgggtacggtcgggtagggggaccgtaaacggggtaccgacgggtacaacccgtccttcccgtacgtaccgccctacccgaaccgaacgggccctacggtccgtccctccccgcgcccaccctccacgacgtacgcaccgtggcgggcacgcgccgccgaggctcgcgtcgacgtacgtactcctcgtcgaagtcgcgtcgnggacggcggcacgg

SEQ ID NO: 356225 - DNA, 590 bp, Homo sapiens
  misc_feature: GZ8MTXP02HXKU4.45.78.H01.1.454.CMB.2.raw
  modified_base (297)..(297): a, c, t, g, unknown or other
  misc_feature (297)..(297): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccaacaggagcccactcccaggtgcagctggtgcagtcgtggggctggagggtgaaagaacgccgtgggccctagagtgaaggtctcctgcaaggtcttgtggaataccaccttccaccggctactatatacagtggngcgacgacggccctaggaacgaaggtctggaggtaggagtagggagtgtaacaccgtaaaacctaacgaagttggagacaacaaactagcgacaagtaagtacgttagacgggtcacgggtcaacgagtacgaacgaagggaccacgtacccatcacgactacgaactaccaatgagggacgtcgaggacgcggaggtgaggagtacgtacgaacggacgacgaccggtcgtacgttactcgtagtcgagaaggacgacggtaaggtaagttacgtttaggtttaggttaagg

SEQ ID NO: 356226 - DNA, 582 bp, Homo sapiens
  misc_feature: GZ8MTXP02FUP2W.45.78.H01.1.454.CMB.2.raw
  modified_base (273)..(273): a, c, t, g, unknown or other
  misc_feature (273)..(273): n is a, c, g, or t
  modified_base (317)..(317): a, c, t, g, unknown or other
  misc_feature (317)..(317): n is a, c, g, or t
  modified_base (419)..(419): a, c, t, g, unknown or other
  misc_feature (419)..(419): n is a, c, g, or t
  modified_base (523)..(523): a, c, t, g, unknown or other
  misc_feature (523)..(523): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcaacaaactatgcacagaagtttcagggcagggtcaccatgaccagggacacgtccatcagcacagcctacatgganctagagcgagctgagatcgagacgacacggccgtatacttctgngcgaggagcgaggtaattacgtatttttagggattaggttacttcggaacggttagtggggactcggtaggggaccgtagggacctacgggtcaccgttccncctacgaccgcctaccgaccgacggtccctacgtcccgtaccctccccgacgtcccacccgttccacgaacgccgaccaccgtcggacggcacgcggccgtcgngctcgcgtcgacgacgtcctacctcgcgaacgtcgtacgtcgacggacggcggacgtcg

SEQ ID NO: 356227 - DNA, 563 bp, Homo sapiens
  misc_feature: GZ8MTXP02I1IJ4.45.78.H01.1.454.CMB.2.raw
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
  modified_base (276)..(276): a, c, t, g, unknown or other
  misc_feature (276)..(276): n is a, c, g, or t
  modified_base (359)..(359): a, c, t, g, unknown or other
  misc_feature (359)..(359): n is a, c, g, or t
  modified_base (440)..(440): a, c, t, g, unknown or other
  misc_feature (440)..(440): n is a, c, g, or t
  modified_base (504)..(504): a, c, t, g, unknown or other
  misc_feature (504)..(504): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtgggcctcagtgaaggtctctgcagctngatacnctcacgctatatatacagtggtcncgacaggcccctggaccgaagggtcttggagtgggagtgggatggataccaaccctaaacaagtgggtagactaacaaacttntgaccacgaagtagttcgagggacgacggtcacagtcgaacgaacggacacgaccatcagacacacgcctaacgagtaggngtagtaggacggaccgaggacgtaggaggtacgtacgacggaccgaacgccggacggttacgtnttacgtcggtggagtaaggaggacgtaacggtaagtttacggtagttttagggttaagg

SEQ ID NO: 356228 - DNA, 863 bp, Homo sapiens
  misc_feature: GZ8MTXP02IQRRV.45.78.H01.1.454.CMB.2.raw
tcagacgcgatcgacacgaccggtgctcgatttagtgtgagtagtttgggtttgggggagcatcacccaccaaccacatctgtcctctagagaatcccctgagagctccgttcctcaccatggactggacctggaggatcctcttcttggtggcagcagccacaggacgcccactcccaggtgcagctggtgcagtcgtggggctggagggtaggaaagaacggccggtcgggggccctacgaggtaggtaacggtcctccgtggacgaacggtcttcgtaggactaccctacccttccgacccggtactaactataactacgacgtgggtcgaccgacgccggtccccgtaagggaaccgtaggggtaccgttaggtaacggtgggtacggtaggggatacgggaaccttaaccccaaaaccccgttaacgtaaggtcggggtacgaaccgtaaactaaaacgttacgtacgaccgtaaacgtaaaggtaacggtttaccggaacggggtaccgaaacggggtacccaacccgaagtaccggaacggaacgggactacccgtacaacgtacgacgaaccaccgacgtaccccgtaagtacggtacggtaaccggttctaccgggaacgaccggtacgggttaaccccgaaggggtaaaccgttaacgggtacccgtaaacggaaacccccggtaaaccggttacccgggggtaacccggtttaggtttaaaacgttacccggggttaacggtacgggaaacccgggtaaggggaaaccgggtacccggttaaaaagggtttacggtttttaaaaccgggggttttacgttttaacgggggtttacgggtttttaaacggggg

SEQ ID NO: 356229 - DNA, 594 bp, Homo sapiens
  misc_feature: GZ8MTXP02JPFHD.45.78.H01.1.454.CMB.2.raw
  modified_base (249)..(249): a, c, t, g, unknown or other
  misc_feature (249)..(249): n is a, c, g, or t
  modified_base (259)..(259): a, c, t, g, unknown or other
  misc_feature (259)..(259): n is a, c, g, or t
  modified_base (378)..(378): a, c, t, g, unknown or other
  misc_feature (378)..(378): n is a, c, g, or t
  modified_base (472)..(472): a, c, t, g, unknown or other
  misc_feature (472)..(472): n is a, c, g, or t
  modified_base (553)..(553): a, c, t, g, unknown or other
  misc_feature (553)..(553): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagcgtggtgcgaggtcgtggggctggaggtagaaacgaggccgtgggcctgagtgaggtctccgngcagtcttgngactacactcgacgtctatatactacgacgtggcgcgacgccggtaccctggaacgaaggtcttggagtgggtagtgggatagactaaccaaaccgtaaccgagttggacacaactaantgacaacgaagtacgtagacgggacgagggccacgacgtacggacggaagacccgtactaccgtacgcgaacgacgaccgtaacgaccgtaaanggtaaggacgtccgtaagacgtacgacggacgtagacgttagacgacgaaccggtacgtacggacgtagtttacgtacggngaacgagaagtagaacgtaagttagttacgtttagtacgtg

SEQ ID NO: 356230 - DNA, 593 bp, Homo sapiens
  misc_feature: GZ8MTXP02IWFKH.45.78.H01.1.454.CMB.2.raw
  modified_base (249)..(249): a, c, t, g, unknown or other
  misc_feature (249)..(249): n is a, c, g, or t
  modified_base (288)..(288): a, c, t, g, unknown or other
  misc_feature (288)..(288): n is a, c, g, or t
  modified_base (457)..(457): a, c, t, g, unknown or other
  misc_feature (457)..(457): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagagcctggggcctcagtgaggtctctgcaggcttnggatacacttcaccggctactatatacagtggtgcgacncggccctggaacgaaggcttggagttgggagtgggagtggactaccaaacctaacaagtggtacgacaactaaactatgacaactaagtaagttccgaggggctacgggtacctacagtcgaaaccggagggaaccacgtccaatcgagaccacgtaagcccttaaagngtacggagtcggtagaacgcgtaggacgtacgagtacgtacgtacgaccggacgacggtacgttagttacgtcgtacggtacgacggaagtacggtaacgtaacggttaacgtttacggtttaggtttaggtacgg

SEQ ID NO: 356231 - DNA, 687 bp, Homo sapiens
  misc_feature: GZ8MTXP02I7G0W.45.78.H01.1.454.CMB.2.raw
  modified_base (245)..(245): a, c, t, g, unknown or other
  misc_feature (245)..(245): n is a, c, g, or t
tcagacgcgatcgacacgaccggtgctcgatttagtgtgagtagtttgggtttggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagagccgtgggctcagtgaaggtctctgcagtctntggatacaccttcgaccggtctactatatacacgtggtcgacgtacgacggcccccgtaggaacgaaggggtcttaggagggttagggaggtagggtagtagggtactacccggtaaaaccctaaacgtaacgtacgggtacgactaaacgtaaaccttagtacggtaccaacggtaaacgttaaacggtttacggaagggggtacgtaacgggggtaccaaccgtaacggtacggaacccggaagggaacctaccggtacctaactaccgaacgaccaaccgacgtaccccgtagaacggttaggggacaccggtaggaccggtacggaccggtacgttaggacgtaacgtcgtaacggaacccgtacggaccggtccgtagttacttacgaggtcgtacggaaggtacgtacgtagggtattacgtttagtttaggtagg

SEQ ID NO: 356232 - DNA, 739 bp, Homo sapiens
  misc_feature: GZ8MTXP02FP3W2.45.78.H01.1.454.CMB.2.raw
  modified_base (277)..(277): a, c, t, g, unknown or other
  misc_feature (277)..(277): n is a, c, g, or t
  modified_base (335)..(335): a, c, t, g, unknown or other
  misc_feature (335)..(335): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaaccctaacaatggtggcaacaaactatgcaacgagtaagtttcagggcagggtcaacataaccagggacacgtcatcagcacagcctacatagganctaggagccgagctagaggtctcgagacgacgccgtactgtactacgtgtcgcgtagnggcgaagtattacgtagtttagacgttgttagtacggacgtagtgggtaccgtcggtcggggaaccgaacggtaccgtacggtacgtcccgtaacgtcctacccgtaacgtccccgttaacaacccggtaccgggaccccttaacggtttccggtacccccgtttcccccgacggttaccccggtacccccttaaccggttacccaacggttacccgaccgtaccccgtacggggtacgggggtaaccctaacggtaccggttccccggggccgttaacggggtccgtaaccggtccccggtacgggtaaccgttaaaccggggtctttaccccgtttacgggacctttcgcccgggttaaccggttgaaaccggttcggggccggtaacggtcgggtaaccgg

SEQ ID NO: 356233 - DNA, 656 bp, Homo sapiens
  misc_feature: GZ8MTXP02FIYUW.45.78.H01.1.454.CMB.2.raw
  modified_base (652)..(652): a, c, t, g, unknown or other
  misc_feature (652)..(652): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcacatgaccaggacacgtccatcagcacagcctacagtggacgcgtgacgcgaggctggagatcgtgacgacaccggccgttagtacttacgtgtcggacgaggaggacgaaggtaacgtttacgtagtttttggagttcggttagttacgggtacgttagtcgggacgtcggtcgggggacccgaaggggacccgacggtccgtacccggtcctcccgtaccgacgtcccctacccgaaccgaccgggacccctacgttcccggtaccccttccccgtcggcccaccccttcccgtaccgaacgaccgtacccaccccgttcggacggggccaccgacggcccggccgtcgggcctcgccgtcggtaccgaacgtccttacctcccgtacgaacgtccgtcggtccgaggacggccgggacncggg

SEQ ID NO: 356234 - DNA, 656 bp, Homo sapiens
  misc_feature: GZ8MTXP02HTGZF.45.78.H01.1.454.CMB.2.raw
  modified_base (137)..(137): a, c, t, g, unknown or other
  misc_feature (137)..(137): n is a, c, g, or t
  modified_base (188)..(188): a, c, t, g, unknown or other
  misc_feature (188)..(188): n is a, c, g, or t
  modified_base (260)..(260): a, c, t, g, unknown or other
  misc_feature (260)..(260): n is a, c, g, or t
  modified_base (265)..(265): a, c, t, g, unknown or other
  misc_feature (265)..(265): n is a, c, g, or t
  modified_base (274)..(274): a, c, t, g, unknown or other
  misc_feature (274)..(274): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (301)..(301): a, c, t, g, unknown or other
  misc_feature (301)..(301): n is a, c, g, or t
  modified_base (326)..(326): a, c, t, g, unknown or other
  misc_feature (326)..(326): n is a, c, g, or t
  modified_base (328)..(328): a, c, t, g, unknown or other
  misc_feature (328)..(328): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtncgacaggcccctggacaagggcttgagtggatgggatggatcaaccctaanaatggtgcaacaaatatgcacagaagtttcaagggcaggggtcaccatcgaaccaggggacacgtccatcanctacngcccctaanagtggatcnggancgagctagagatcngaccgatcggctagtaacttctggngngagagagtaagtacttagttgtttgggagttgtagtggtagttgtcggtcgtgcggacgaggcctcggtccaccgtctccgcgactccctccgacgaccggtccctacgtccccgttccctccccgtacgcccctaccccgtaccaccgaacgtaccgccctaccggttcccgggtcgggaaccctaccggacccgggttcccggtcccgggtcggtccgtaccggtacccggttacgtaaccggtaaacgttaccccgtttaccttcccggacgttcccgttcccgggtaccggtttcgcggggaaccggtccggtacggtaccggg

SEQ ID NO: 356235 - DNA, 625 bp, Homo sapiens
  misc_feature: GZ8MTXP02HEMF3.45.78.H01.1.454.CMB.2.raw
  modified_base (289)..(289): a, c, t, g, unknown or other
  misc_feature (289)..(289): n is a, c, g, or t
  modified_base (490)..(490): a, c, t, g, unknown or other
  misc_feature (490)..(490): n is a, c, g, or t
  modified_base (527)..(527): a, c, t, g, unknown or other
  misc_feature (527)..(527): n is a, c, g, or t
  modified_base (544)..(544): a, c, t, g, unknown or other
  misc_feature (544)..(544): n is a, c, g, or t
  modified_base (566)..(566): a, c, t, g, unknown or other
  misc_feature (566)..(566): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactaatgcacagtaagtttcagggcagggtcaccgatgacaggaacacgtccatcagcacagcctacatggagctagagtcgaggtcnggaagcgttacgtgaaaccgaccgtaccggcccggtagtaatttacgtgttcgacgaggacgtcgaagtaaagtttactagtttttagggagttacgtttagttccgggtagttagtcggggtacgtcggtaggggaccgtaacgggacccgtacgtccgacccgtctaccgtcaacgtcccacgaccgtaccggcctacncccggtacctcccgtcgcctacccgctacaacggacnctccgtcgtggggaccncgtaacgccgtcgtaacgggcncgtcgtacgcgtaacgaccttccgtcacgtaacgtcgaccgtgtgacggcgtacgacgg

SEQ ID NO: 356236 - DNA, 629 bp, Homo sapiens
  misc_feature: GZ8MTXP02HYMXE.45.78.H01.1.454.CMB.2.raw
  modified_base (277)..(277): a, c, t, g, unknown or other
  misc_feature (277)..(277): n is a, c, g, or t
  modified_base (289)..(289): a, c, t, g, unknown or other
  misc_feature (289)..(289): n is a, c, g, or t
  modified_base (292)..(292): a, c, t, g, unknown or other
  misc_feature (292)..(292): n is a, c, g, or t
  modified_base (316)..(316): a, c, t, g, unknown or other
  misc_feature (316)..(316): n is a, c, g, or t
tcagacgcgatcgacacgaccggtgctcgatttagtgtgagtagtttgggtttggggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatcgacagggacacgtccatcagcacagcctacatggagctagngcgagcgtgagntcngtaacgacacggtcgtgattacgngtgcgagaggcaaggtaattacggaatttttggagttggttaagttcggacggttagtgggacgttcggacggggccgaaagggtcccgaacggtccctaacccgtccctacctaccgacgaccctccgaaccgaaacgggccctaagtccgggtccttccccgtcggcctaccccgtcctaccgaaacgtccggacctaccgtcggtacggggccacggcgtccgtacccgcgggcctacgggtcctcggtaacgacggtaaccttcccgtacgtccgtaacgtcccgtacgtacgtcgacggcggtcgtcg

SEQ ID NO: 356237 - DNA, 603 bp, Homo sapiens
  misc_feature: GZ8MTXP02JKCGE.45.78.H01.1.454.CMB.2.raw
  modified_base (274)..(274): a, c, t, g, unknown or other
  misc_feature (274)..(274): n is a, c, g, or t
  modified_base (324)..(324): a, c, t, g, unknown or other
  misc_feature (324)..(324): n is a, c, g, or t
  modified_base (416)..(416): a, c, t, g, unknown or other
  misc_feature (416)..(416): n is a, c, g, or t
tcagacgcgatcgacacgaccggtgctcgatttagtgtgagtagtttgggtttggggtgaagaagcctgggccctcagtgaaggtctcctgcaaggcttctggatacaccttcaccggctactatatacactgggtgcgacaggcccctggacaagggcttgagtggatgggatggatcaaccctaacaatggtggacacaaactatgcaacagaagtttcagggcagggtcaccatgaccagggacacgtccatcagcacagcctacatgganctgagcgaggctgagatcgtagacgacacggccgtagtattactggtcgngaggagacgaggtaattagtagtttggagttgttagtcggagtatggggtactcggtaggggaccaagggacctacggccacgtcctacccncgacgccacccgaccgaccggcctacgtcccgtccctccccgtaccgaccctaccctccaccgaacgccgacccaccgtccggaccgggaccacggccggccgccgtacggtcgtcgtccgtacggacgtaacgtaccgttaccttccgtacgaacgtccgtacgtcgtacggcggtccggcgacgg

SEQ ID NO: 356238 - DNA, 553 bp, Homo sapiens
  misc_feature: GZ8MTXP02JN4GG.45.78.H01.1.454.CMB.2.raw
  modified_base (250)..(250): a, c, t, g, unknown or other
  misc_feature (250)..(250): n is a, c, g, or t
  modified_base (286)..(286): a, c, t, g, unknown or other
  misc_feature (286)..(286): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaaggcttcnggatacaccttcaccggctactatatacactgggtncgacaggcccctggacaggcttgagtggatgggatggatcgaacctaacaagtggtaggcaacaaactatgcacaagagtttcaggggcagggtcacgatcgacgaggacacgtccatcagcacagcctaacagtacggagccgtagtacgcgagggctaggacgtacgtacgtacgtaaccgacgtacggccggttagtaacgttacgtaggtcgacggtaagacggacgtagggtaacgttacggttaacggtttttaggaacgg

SEQ ID NO: 356239 - DNA, 796 bp, Homo sapiens
  misc_feature: GZ8MTXP02I05EX.45.78.H01.1.454.CMB.2.raw
  modified_base (249)..(249): a, c, t, g, unknown or other
  misc_feature (249)..(249): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcgagtcgtggggctggaggtagaaggaaggccgtggggcctcgaggtgaaggtcctcngcgaaggtcttcgtaggatacacctcgaccgctactatactacacgttgggtagacgacgacggccccgtaggaccgaaagggtcgttagggacggtagggtaggtgggacgtaggtactacgtaaaccctaagtaagtgggtacgaactaactaaaaccgtagtcgacgtaacaaggtaacgttagacggggtacgtacgggtacccaacgtagtaccgaaccggacgggaacccgtaaaccgtccgaacgttaccaacgggtaccaaccgacggtaaaccccgtaacgtagggttacgggaaccgtcggttaccggaacgggaacgttaacccgggggtcgtaaacggtaacggtaaccgttaacccgggaacccggtaaaccgggtaaccgggttaaccccggggtcggttttaaaccggtttaaacccggtttacggggtacggggttaacgggtaccgggtaaacgggtaaccggggtaaacggttaaaacgggtttaacggttttaacgggttttacggggtttttaaacgggggtttagg

SEQ ID NO: 356240 - DNA, 645 bp, Homo sapiens
  misc_feature: GZ8MTXP02HARG6.45.78.H01.1.454.CMB.2.raw
  modified_base (323)..(323): a, c, t, g, unknown or other
  misc_feature (323)..(323): n is a, c, g, or t
  modified_base (374)..(374): a, c, t, g, unknown or other
  misc_feature (374)..(374): n is a, c, g, or t
tcagacgcgatcgacacgaccggtgctcgatttagtgtgagtagtttgggtttgggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctcagtgaaggtctcctgcaaggcttctggatacacccttacgacccggctactatataccgactgggtagccgacaggcccccgtggacaagggcttgngtggatgggatggatcgaacccaaccagtcggtaggcctaacaaacgttcngcacgagtaacgtttcgacgggggcaaggggtccaacgtactacgacgacggtacccgacgtaccctagtcgacggacaccgaacgtcccgtaaacgatacgggagtaccgtagacggacgacgggtacctaggtaacgacgtaaccgttacggaacccgtaaacgtaccggggtacccgtaggtttaccgttaacggtacggtggtaaccggtaacggtaggtaaccgtaagggtaactttacgggtttaacgttttacgggttaaaggg

SEQ ID NO: 356241 - DNA, 612 bp, Homo sapiens
  misc_feature: GZ8MTXP01D6AW0.17.80.H03.1.454.CMB.2.raw
  modified_base (267)..(267): a, c, t, g, unknown or other
  misc_feature (267)..(267): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (283)..(283): a, c, t, g, unknown or other
  misc_feature (283)..(283): n is a, c, g, or t
  modified_base (286)..(286): a, c, t, g, unknown or other
  misc_feature (286)..(286): n is a, c, g, or t
  modified_base (293)..(293): a, c, t, g, unknown or other
  misc_feature (293)..(293): n is a, c, g, or t
  modified_base (331)..(331): a, c, t, g, unknown or other
  misc_feature (331)..(331): n is a, c, g, or t
  modified_base (381)..(381): a, c, t, g, unknown or other
  misc_feature (381)..(381): n is a, c, g, or t
  modified_base (406)..(406): a, c, t, g, unknown or other
  misc_feature (406)..(406): n is a, c, g, or t
tcagcgtagactagcacgaccggtgctcgatttagctgtgcgtcgaagggaaaggggacccaaaaaccacacccctccttgggagaatcccctagatcacagctcctcaccatggactggacctggagcattccttttcttggtggcagcagcaacaggtcgcccactcccaggttcaactggtgcagtctggaggtgaggtagaagagcgtgggctgagtgagtcctctgacacgtctctgtactaccttacatagtgtatgtggngcgcngccngacaggntgngtggagnggatgactgacacctaaatagttaagaaactaattagngacagaggacgaccgtacgaagggtacgacgtccaacccgtagaacctanacgaaccacactaccaaactaaacncaacgacctagattacggaacttaggacgttacctagggactaagttcgaacgtaccgtacggttcctttagtattacgtggacgtaggaagtagggtggaggggtacggggtcggtggtcgcgttcggacccggtttcgtacggggttcgttacgcgggttacgggccggtacgaaccggtccgtacgttcctaaccgttctccg

SEQ ID NO: 356242 - DNA, 638 bp, Homo sapiens
  misc_feature: GZ8MTXP02IBIRK.17.80.H03.1.454.CMB.2.raw
  modified_base (241)..(241): a, c, t, g, unknown or other
  misc_feature (241)..(241): n is a, c, g, or t
  modified_base (275)..(275): a, c, t, g, unknown or other
  misc_feature (275)..(275): n is a, c, g, or t
  modified_base (318)..(318): a, c, t, g, unknown or other
  misc_feature (318)..(318): n is a, c, g, or t
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
tcagcgtagactagcacgaccggtgctcgatttagctgtgcgtcgaagggaaaggggacccaaaaaccacacccctccttgggagaatcccctagatcacagctcctcaccatggactggacctggagcatccttttcttggtggcagcagcaacaggtgcccactcccaggttcaactggtgcagtctggaggtgaggtgagaagcctggggcctcagtgaaggtctcctgcaaggcctntggtacaccttacaactatgtattagtggtgcgnaggccctgacaggctgagtggagtggatggatcagaccctaanagttaggtaaaacaaattangacacagagcctacgagggtanacgtcaccgtgaccacagacacatacccaataacacacgacctacatacggaaacttggaacggtaccttaggacgttagtttacgaaaccgtaccgtaccgggtaccttttactaacgtttacgtaggtgacgtaggtaggtagggagggagggggtcggtaagggttgccggttacggacgttaccccggggcgggttacgggggttcccgaaccgaccggtcgggggacccaacgggggtaacccgtcggggttacccacccggttccgtccccg

SEQ ID NO: 356243 - DNA, 547 bp, Homo sapiens
  misc_feature: GZ8MTXP02FJDBP.17.80.H03.1.454.CMB.2.raw
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
  modified_base (533)..(533): a, c, t, g, unknown or other
  misc_feature (533)..(533): n is a, c, g, or t
tcagcgtagactagcacgaccggtgctcgatttagctgtgcgtcgaagggaaaggggacccaaaaaccacacccctccttgggagaatcccctagatcacagctcctcaccatggactggacctggagcatccttttcttggtggcagcagcaacaggtgcccactcccaggttcaactggtgcagtctggaggtgaggtgaagaagcctggggcctcagtgaaggtctcctgcaaggcctctggttacacctttaccaactatggtattagttgggtgcggcaggcccctggacaagggcttgagtggatgggatggatcagccctaacattaggaaaacaaattatgcacagaggcctccgagggtagagtcaccctgaccacagacacatccactaaacacagcctacatggaactgaggaccttgagtattgacgacacggccttntattacngtgcgagagtgaggaggggcggtgggtagcgtgctaccggcggtcggggttcaccgacgtggggccacgggacccngtcaccgtctcccg

SEQ ID NO: 356244 - DNA, 525 bp, Homo sapiens
  misc_feature: GZ8MTXP01EQ3E2.22.36.D03.1.454.CMB.2.raw
  modified_base (465)..(465): a, c, t, g, unknown or other
  misc_feature (465)..(465): n is a, c, g, or t
  modified_base (519)..(519): a, c, t, g, unknown or other
  misc_feature (519)..(519): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttatggtgtcactcgtcggccctcaggagtctcctcatcgcttctcaggctccaaagtctggcaacacggcctccctaacatctctgggctcccagtttgaggacgagtctaacttattactgctagttcctttaaattaggcgcctactctcgtggtttcgnggtaagcaccgagttgaccgtcttcggttcacgccaggctcgccccttcggtcncgtccg

SEQ ID NO: 356245 - DNA, 533 bp, Homo sapiens
  misc_feature: GZ8MTXP01BJ8BB.22.36.D03.1.454.CMB.2.raw
  modified_base (321)..(321): a, c, t, g, unknown or other
  misc_feature (321)..(321): n is a, c, g, or t
  modified_base (357)..(357): a, c, t, g, unknown or other
  misc_feature (357)..(357): n is a, c, g, or t
  modified_base (386)..(386): a, c, t, g, unknown or other
  misc_feature (386)..(386): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccggggggtccctgacactctcctgtgcagcctctggattcacagtcagcagcaatgccatgagttggccgcaggctccgagggaaggggttncagtgggtctcgggggattggaagtgatggtgccanacaactacgcagactccgtgagggggccnttcatcatctccagagacgattaccgaaacacagtgaatctggacaaatgtacagcctcagcgcgaggacacggccgtctacttctgttgacgaacgaccttcttacttttgggccgtcggccgacgttacgtcggggccgaacggg

SEQ ID NO: 356246 - DNA, 528 bp, Homo sapiens
  misc_feature: GZ8MTXP01EGYN0.22.36.D03.1.454.CMB.2.raw
  modified_base (307)..(307): a, c, t, g, unknown or other
  misc_feature (307)..(307): n is a, c, g, or t
  modified_base (370)..(370): a, c, t, g, unknown or other
  misc_feature (370)..(370): n is a, c, g, or t
  modified_base (493)..(493): a, c, t, g, unknown or other
  misc_feature (493)..(493): n is a, c, g, or t
  modified_base (521)..(521): a, c, t, g, unknown or other
  misc_feature (521)..(521): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacaccccaggccaaaccccccaatcatcatttanggtgtcactcgtcggcccttcaggagtctcctcatcgcttctcaggctccaagtctggcaacncggcctccctaacatctctgggctccagtttgaggacgagtctaacttattactgtctaagtttcctttaaattaggctcctactctcgtggttttcggcggtaagcacgaagttgaccgtcncgttcacgccagctcgccccttcggtcncgttccg

SEQ ID NO: 356247 - DNA, 524 bp, Homo sapiens
  misc_feature: GZ8MTXP01E2JGC.22.36.D03.1.454.CMB.2.raw
  modified_base (484)..(484): a, c, t, g, unknown or other
  misc_feature (484)..(484): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaatcatcatttatggtgtcactcgtcggccctcaggagtctcctcatcgcttctcaggctccaaagtctggcaacacggcctccctaacatctctgggctccagtttgaggacgagtctacttattactgcagttccttaaattagcgcactctcgtggttttcggcggaaggcaccggaagttgaccgtcncggttcacggcccaaggctcggccccttcggtcaacttcc

SEQ ID NO: 356248 - DNA, 530 bp, Homo sapiens
  misc_feature: GZ8MTXP01EJMGF.22.36.D03.1.454.CMB.2.raw
  modified_base (524)..(524): a, c, t, g, unknown or other
  misc_feature (524)..(524): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggccaaaccccccaactcatcatttatgtgtcactcgtcggccctcaggagtctcctcatcgcttctcagctcaagtctggcaacacggcctccctaacatctctgggctccagtttgaggacgagtctacttattactgctagtttacctttaaattaggcgtccacttctccgttggttttcggcggaaggtcaccggaagttgaccgtcttcggttcacgcccaggctcgccccttcggtcncgtccg

SEQ ID NO: 356249 - DNA, 548 bp, Homo sapiens
  misc_feature: GZ8MTXP01AEI8N.22.36.D03.1.454.CMB.2.raw
  modified_base (396)..(396): a, c, t, g, unknown or other
  misc_feature (396)..(396): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccgggggggtccctgacactctcctgtgcagcctctggattcacagtcagcagcaatgccatgagttgggccgccaggctccgaggggaagggggttgcgagtggggtctcgggggattgggaagtgactggtgccacacaactacgcagactccgtgacgggggccncttcatcatctccagagacgattaccgaaaacacagtagaatctaggacaaatgtacagcctcagcgccgaggacacggccgtctacttctgttgcgaaagccttcttagttttcgggccgtcggcccgacgttacgtcggggccgaacggg

SEQ ID NO: 356250 - DNA, 517 bp, Homo sapiens
  misc_feature: GZ8MTXP01DY6FU.22.36.D03.1.454.CMB.2.raw
  modified_base (324)..(324): a, c, t, g, unknown or other
  misc_feature (324)..(324): n is a, c, g, or t
  modified_base (339)..(339): a, c, t, g, unknown or other
  misc_feature (339)..(339): n is a, c, g, or t
  modified_base (511)..(511): a, c, t, g, unknown or other
  misc_feature (511)..(511): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtctttgactctgtctctggtaccaacaacacccagccaaacccccaatcatcatttatgtgtcactcgtcgcctcaggntctctcatcgcttcncaggctcaagtctgcaacacgccctcctaacatctctggctcctagtttgaggacgagtctacttattactgtctagtttacctttaaagttacgcgtcctactctcgttggtttcggcggaagcgacgagttcgaccgtcttcggttcacgccaagctcgccccttcgtcncgtccg

SEQ ID NO: 356251 - DNA, 542 bp, Homo sapiens
  misc_feature: GZ8MTXP01EIBCF.22.36.D03.1.454.CMB.2.raw
  modified_base (249)..(249): a, c, t, g, unknown or other
  misc_feature (249)..(249): n is a, c, g, or t
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
tcagacatacgcgtcacgaccggtgctcgatttagctgcgtcacgatctctcttggggtggggtctcaggaggcagcactctcgggacgtctccaccatggcctgggctctgctcctcctcagcctcctcactcagggcacaggatcctgggctcagtctgccctgactcagcctcgctcagtgtccggtctcctggacagtccgtcaccatctcctgcactgggaccagcagtgatgttggtgcttanaactatgtctctggtaccagcaccacccaggcaaacgcccccaatctttaattttggtgtcaataaccgcccctcgacggggtccctgactcgcttctcccggctccaagtctggcaacaccggcctccctgacccatctctggacctccgaggctgacgatgagggtntacttttacgngtcttgctcatatgacagcctaattataataagtggttcgttcgggcggaagggaacccttaaaggttcgaacccgtccgtaaggtcacgcccgaaggtccgttcgtcccccg

SEQ ID NO: 356252 - DNA, 554 bp, Homo sapiens
  misc_feature: GZ8MTXP01ANJ34.22.36.D03.1.454.CMB.2.raw
  modified_base (394)..(394): a, c, t, g, unknown or other
  misc_feature (394)..(394): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccgggggggtccctgacactctcctgtgcagcctctggattcacagtcagcagcaatgccatgagttgggtccgccaggctccgaggggaagggggttgcgaggtgggtctcgggggattggaagtgatgggtgccacacaactacgcagactcgtgaggggccnttcatcatctcagagacgattaccgaaaacacagtgaatctaggacaaatgtacagcctcagcgcgagacacggccgtctacttctcgcgtacgaaacgttaccttcgttacgttttcgggccgtccgggcccgtacgttacgtcggggccgaaccgggg

SEQ ID NO: 356253 - DNA, 569 bp, Homo sapiens
  misc_feature: GZ8MTXP01EDABH.22.36.D03.1.454.CMB.2.raw
  modified_base (218)..(218): a, c, t, g, unknown or other
  misc_feature (218)..(218): n is a, c, g, or t
  modified_base (251)..(251): a, c, t, g, unknown or other
  misc_feature (251)..(251): n is a, c, g, or t
  modified_base (560)..(560): a, c, t, g, unknown or other
  misc_feature (560)..(560): n is a, c, g, or t
  modified_base (568)..(568): a, c, t, g, unknown or other
  misc_feature (568)..(568): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgagggaaggggttgcagtgggtctcggggattggaagtgatggtgccacacactacgcagactccgtgaggggccncttcatcatctccagagacgattaccgaaaacncagtgaatctgcaaatgtacagcctcagcgccgaggacacggccgtctactctgtgacgaaagacctctagtttttcgggccgcggccgacgtacgtcggggccaggggcaacccgtggtcaccgtctcttcacgcctccaccgaacgggcccagtccggtccttcccccgtggcccgccccttcggcctccgaggcgccaccctccgggaacgacgccacgacgccggccccgtgggcctgcccgtggtaccgaaggaacctacgttccgacgcgtaatggttccttggcggcgggcgtggcgaggcncgttaagng

SEQ ID NO: 356254 - DNA, 539 bp, Homo sapiens
  misc_feature: GZ8MTXP01ALJP9.22.36.D03.1.454.CMB.2.raw
  modified_base (305)..(305): a, c, t, g, unknown or other
  misc_feature (305)..(305): n is a, c, g, or t
  modified_base (510)..(510): a, c, t, g, unknown or other
  misc_feature (510)..(510): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctggtaccaacaacacccaggaccaaaccccccactcatcatttangtgtcactcgtcggccctcaggagtctcctcatcgcttctcagctccaagtctcggcaacacgccctccctaacactctcgtgggctccgtagtttgacggacgagtctacttatacgtgtctagtttacctttaaagttcggctcctacttcgttcgttggttttcggcggtaagcagtcgagtcgtaccgttccgttcgttcncgcccaagcctcgcccctcggttctaacc

SEQ ID NO: 356255 - DNA, 551 bp, Homo sapiens
  misc_feature: GZ8MTXP01DC2LP.22.36.D03.1.454.CMB.2.raw
  modified_base (303)..(303): a, c, t, g, unknown or other
  misc_feature (303)..(303): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccggggggtccctggacactctcctgtgcagcctctggattcacagtcagcagcaatgccatgagttgggccnccaggctccgaggggaagggggttgcgaggtgggtctcgggggattgggaagtgactgggtgccacacaacctacgcagacctcccggtgacgggggccgcttcatcatctccagagacgattaccgaaacacagtgaatctggacaaatgtacagcctcagcgccgaggacaccggccgtctacttctgttgcgaacgccttcttagttttcgggccgcggtccgacgttacgtcgggccgaacggg

SEQ ID NO: 356256 - DNA, 511 bp, Homo sapiens
  misc_feature: GZ8MTXP01BRW3G.22.36.D03.1.454.CMB.2.raw
  modified_base (306)..(306): a, c, t, g, unknown or other
  misc_feature (306)..(306): n is a, c, g, or t
  modified_base (442)..(442): a, c, t, g, unknown or other
  misc_feature (442)..(442): n is a, c, g, or t
  modified_base (460)..(460): a, c, t, g, unknown or other
  misc_feature (460)..(460): n is a, c, g, or t
  modified_base (508)..(508): a, c, t, g, unknown or other
  misc_feature (508)..(508): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaactcatcatttanggtgtcactcgtcggccctcaggagtctcctcatcgcttctcaggctccaagtctggcaacacggccctccctaacatctctggctccagtttgaggacgagtctacttattactgctagttccttaaattaggcnccactctcgtggtttcgnggaagcacgagttcgacgtcttcggttcagcccagctgccccttgtcnctc

SEQ ID NO: 356257 - DNA, 541 bp, Homo sapiens
  misc_feature: GZ8MTXP01D9NIK.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggccaaaccccccaactcatcatttatggtgtcactcgtcggccctcaggagtctcctcatcgcttctcaggctccaaagtctggcaacacggccctccctaaccatctctgggctccagtttgaggacgagtctattattactgctagttcctttaaagttgcgtccactctcggttggtttcggcggtaaggcaccggtaaagttgaccgtccttcggttcacgcccaaggcctcgcccccttcggtccgttaactcccg

SEQ ID NO: 356258 - DNA, 524 bp, Homo sapiens
  misc_feature: GZ8MTXP01D3FQZ.22.36.D03.1.454.CMB.2.raw
  modified_base (460)..(460): a, c, t, g, unknown or other
  misc_feature (460)..(460): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacaccccaggccaaaccccccaatcatcatttatggtgtcactcgtcggccctcaggagtctctcatcgcttctcagctcaagtctgcaacacgcctcctaacatctctggctccagtttgaggacgagtctacttattactgctagttacctttaaattacggcgcctactctcgttggtttcggnggtaagcacgaagttcgaccgtcttcggttcacgtcccaaggctcgccccttgtccaacgttcc

SEQ ID NO: 356259 - DNA, 589 bp, Homo sapiens
  misc_feature: GZ8MTXP01AP6VJ.22.36.D03.1.454.CMB.2.raw
  modified_base (328)..(328): a, c, t, g, unknown or other
  misc_feature (328)..(328): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggccaaaccccccaactcatcattatggtgtcactcgtcgccctcaggngtctcctcatcgtctctcaggctccaagtctggcaacacgcctccctaaccatctctgggcctcctagtttcgagacgtagttctacttattacgtgtctagttaccctttaaatacggctacctactcgttcggttcggttttccgggcgggtaacggtcgttaaccggtaaggttccggaacccggttcccgttccgggttccacggtccccgtaacgggtccctccggccccccgttcgggtcccgttaaccttcccg

SEQ ID NO: 356260 - DNA, 566 bp, Homo sapiens
  misc_feature: GZ8MTXP01CZ2U8.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctctggtaccaacaacacccaggccaaaccccccatcatcatttatggtgtcactcgtccggcctcaggagtctctcatcgcttctcaggctccaagtctggcaacacggccctccctaacactctcgtgggactccgagtttgagacgtagtcttacttattactgtctacgtttacctttaaattacggccgtcctacgttcttcggtttcgggttttccggcgggtaacggcgaccgtaagttcgacccgtccgttcgggttccacgcccaacgggtcctcgccccgttcggtccaacgttcccg

SEQ ID NO: 356261 - DNA, 541 bp, Homo sapiens
  misc_feature: GZ8MTXP01DV6YV.22.36.D03.1.454.CMB.2.raw
  modified_base (330)..(330): a, c, t, g, unknown or other
  misc_feature (330)..(330): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttgggccgccaggctccgagggaaggggttncgagtgggctcgggggattgggaagtgagtggtgccaacgacactacgcagactccggtgaggggccgcgttcatcatctccagagacgacttaccgaaaacaccaaggtagaatctagacaaatgtacaagcctcgagcgccgaaggcacggccgttcgtactcttgttcgacgaagtacctcttagtttcgggaccgtcggccgtaacg

SEQ ID NO: 356262 - DNA, 537 bp, Homo sapiens
  misc_feature: GZ8MTXP01AOM10.22.36.D03.1.454.CMB.2.raw
  modified_base (530)..(530): a, c, t, g, unknown or other
  misc_feature (530)..(530): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccactcatcatttatgtgtcactcgtcggccctcaggagtctctcatcgcttctcaggctcaagtctggcaacacggccctccctaacatctctgggctccagtttgaggacagtctacttattactgtctagttaccctttaaatacggcgcctactcgtcgttggtttcgggcggtaaggcgaccgaaagttcgaaccgttcttcggttcacgtccgaggcctcggccccttcggtccncttcccg

SEQ ID NO: 356263 - DNA, 576 bp, Homo sapiens
  misc_feature: GZ8MTXP01BLZHR.22.36.D03.1.454.CMB.2.raw
  modified_base (456)..(456): a, c, t, g, unknown or other
  misc_feature (456)..(456): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctggtaccaacaacacccaggaccaaaccccccatcactcatttatgtgtcactcgtcggcctcaggagtctcctcatcgtcttctcaggtctccaagtctggacaacacggccctaccctaacatctctgggctccgtagtttgaggacgtagtctaacttattactgtacttacgttacctttaaagtacggccncctacttctcggttggttttacggcggtaacggccgacggtaacgttcgtaacccgtccgttcgggttcaccggcccgtaacgggcctcccggcccccttcggtccttaaccgtttcccg

SEQ ID NO: 356264 - DNA, 514 bp, Homo sapiens
  misc_feature: GZ8MTXP01DQP4K.22.36.D03.1.454.CMB.2.raw
  modified_base (456)..(456): a, c, t, g, unknown or other
  misc_feature (456)..(456): n is a, c, g, or t
  modified_base (508)..(508): a, c, t, g, unknown or other
  misc_feature (508)..(508): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctggtaccaacaacacccaggcaaacccccaactcatcatttatgtgtcactcgtcggcctcagagtctctcatcgcttctcagctcaagtctggcaacacggcctccctaacatctctgggctccagtttgaggacgagtctacttattactgtctagttcctttaaattacgcgcctactctcgttggtttcggnggaagcacgaagttgaccgtcttcgttcacgccaggctcgccccttcggtcncgtccg

SEQ ID NO: 356265 - DNA, 554 bp, Homo sapiens
  misc_feature: GZ8MTXP01BJVB9.22.36.D03.1.454.CMB.2.raw
  modified_base (365)..(365): a, c, t, g, unknown or other
  misc_feature (365)..(365): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccggggggtccctgacactctcctgtgcagcctctggattcacagtcagcagcaatgccatgagttgggccgcaggctccgaggggaagggggttgcgaggtgggtctcgggggattgggaagtgatggtgccanacaactacgcagacctcccgtggacggggccgcttcatcatctccagagacgattaccgaaacacagtagaatctaggacaaatgtacagcctcgagccgcgaggaccacggccgtctacttctgttcgacgaacaccgttcttacgttttcgggccgcggtccgacgttacgtcgggttccgaacggg

SEQ ID NO: 356266 - DNA, 519 bp, Homo sapiens
  misc_feature: GZ8MTXP01BLLYI.22.36.D03.1.454.CMB.2.raw
  modified_base (309)..(309): a, c, t, g, unknown or other
  misc_feature (309)..(309): n is a, c, g, or t
  modified_base (365)..(365): a, c, t, g, unknown or other
  misc_feature (365)..(365): n is a, c, g, or t
  modified_base (439)..(439): a, c, t, g, unknown or other
  misc_feature (439)..(439): n is a, c, g, or t
  modified_base (457)..(457): a, c, t, g, unknown or other
  misc_feature (457)..(457): n is a, c, g, or t
  modified_base (512)..(512): a, c, t, g, unknown or other
  misc_feature (512)..(512): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtctttgactctgtctcctgtaccaacaacacccacggaccaaaccccccatcatcatttatgtntcactcgtcggcctcaggagtctcctcatcgcttctcagctcaagtctcggcaacncgccctacctaacatctcgtggctccagttgacgacgtagtctattactacgtgctacgttacttaaatcggcnctactctcgtgtttcggngtaacgcacgtagttcgaccgtcttcgttcacgccagcctcgccccttcggtccncgttccg

SEQ ID NO: 356267 - DNA, 605 bp, Homo sapiens
  misc_feature: GZ8MTXP01EN5WS.22.36.D03.1.454.CMB.2.raw
  modified_base (194)..(194): a, c, t, g, unknown or other
  misc_feature (194)..(194): n is a, c, g, or t
  modified_base (220)..(220): a, c, t, g, unknown or other
  misc_feature (220)..(220): n is a, c, g, or t
  modified_base (230)..(230): a, c, t, g, unknown or other
  misc_feature (230)..(230): n is a, c, g, or t
  modified_base (250)..(250): a, c, t, g, unknown or other
  misc_feature (250)..(250): n is a, c, g, or t
  modified_base (274)..(274): a, c, t, g, unknown or other
  misc_feature (274)..(274): n is a, c, g, or t
  modified_base (604)..(604): a, c, t, g, unknown or other
  misc_feature (604)..(604): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccgaggggaaggggttgcaggtgggtctcggggattggaagtgatggtgccanacactacgcagactccgtgagggccnttcatcatcncagagacgattaccgaaaancagtgaatctagacaaatgtacancctcagcgcgaggacacggccgtctacttctgtgacgaaagtacctcttagttttcgggccgcggaccgacctacgtcggggccacgggccaacccgtggtccaccgtctcttcacgccctaccaccgaacgggccctagtccggtccttcccccgtggcccgccctgccctccacgggacaccaacccgccgggaagacggcaaccgcggcccggcccgttgggcctcggtcccgttggaaccgaaacgggtaacccttaaccgttccgacgttaccgtagtcgttccgttgacgggcgggtccgaagggccgaagggccgaattaagng

SEQ ID NO: 356268 - DNA, 662 bp, Homo sapiens
  misc_feature: GZ8MTXP01EFEVX.22.36.D03.1.454.CMB.2.raw
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccgagggaaggggttgcaggtgggtctcggggattggaagtgatggtgccacacactacgcagactccgtggaggggccncttcatcatctccagagacgataccgaaaacncagtgaatctgacaaatgtacagcctcagcgaccgaggaccacggccgtctactctgtgacgaaacgtaccttcgttagtttttcgggcccgtcggaccgtaccctacggtcgggggacccgacggggcccaaaccccgtgggtcccaccgttcctcttccacggtccctaccgaacccgaacggggccctaacgtccggtcccttcccccgtggtccccgccccttcggccctaccgacggacgaccctacccgtaccggacgacgcccaacgacggcccggcccgttcgggccttcggcccgttcggtaccgaaacgggtaaccttaccgttacaccggttcgttagtcggttccgttgggacgggccggggtcgtcgggaccgaacggggcccgtaacgaagtaag

SEQ ID NO: 356269 - DNA, 508 bp, Homo sapiens
  misc_feature: GZ8MTXP01CI3L1.22.36.D03.1.454.CMB.2.raw
  modified_base (246)..(246): a, c, t, g, unknown or other
  misc_feature (246)..(246): n is a, c, g, or t
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
  modified_base (493)..(493): a, c, t, g, unknown or other
  misc_feature (493)..(493): n is a, c, g, or t
  modified_base (505)..(505): a, c, t, g, unknown or other
  misc_feature (505)..(505): n is a, c, g, or t
tcagacatacgcgtcacgaccggtgctcgatttagctgcgtcacgatctctcttgggtttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccgcttcatcatctccagagacgattccgaaaacncagtgaatctgcaaatgtacagcctcagcgccgaggacacggccgtctacttctgtgcgaaagacctctattttgggccgcggccgacctactggggccaggcaaccctggtcaccgtctcttcacgcctccaccaagggcccatcggtctcccctggcgccctncctccagacncacctccggagagccacagccggccctggctgcctggtcaggctacttccacgcgtatgttcttgagcgggntggcagggcgcngtg

SEQ ID NO: 356270 - DNA, 537 bp, Homo sapiens
  misc_feature: GZ8MTXP01A7Z4F.22.36.D03.1.454.CMB.2.raw
  modified_base (217)..(217): a, c, t, g, unknown or other
  misc_feature (217)..(217): n is a, c, g, or t
  modified_base (250)..(250): a, c, t, g, unknown or other
  misc_feature (250)..(250): n is a, c, g, or t
  modified_base (374)..(374): a, c, t, g, unknown or other
  misc_feature (374)..(374): n is a, c, g, or t
  modified_base (420)..(420): a, c, t, g, unknown or other
  misc_feature (420)..(420): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattaccgaaaacncagtgaatctgacaaatgtacagcctcagcgccgaggacacggcgtctacttctgtgcgaaagacctctagtttttcggccgcgccgactacgtgggccaggcaaccctggtcaccgtctctcncgcctcaccaggcccatcgtcctcccctgccgccctgcctccagcncacctcggagcgcacgagccggcccgtgggctcgtcctcggtacaagggaacctaccgttccacgccgttagtcgttcgttgacggcgggcgtcgggcgaagggcgcgttaagtaag

SEQ ID NO: 356271 - DNA, 530 bp, Homo sapiens
  misc_feature: GZ8MTXP01B1H3Q.22.36.D03.1.454.CMB.2.raw
  modified_base (218)..(218): a, c, t, g, unknown or other
  misc_feature (218)..(218): n is a, c, g, or t
  modified_base (444)..(444): a, c, t, g, unknown or other
  misc_feature (444)..(444): n is a, c, g, or t
  modified_base (498)..(498): a, c, t, g, unknown or other
  misc_feature (498)..(498): n is a, c, g, or t
  modified_base (528)..(528): a, c, t, g, unknown or other
  misc_feature (528)..(528): n is a, c, g, or t
  modified_base (530)..(530): a, c, t, g, unknown or other
  misc_feature (530)..(530): n is a, c, g, or t
tcagacatacgcgtcacgaccggtgctcgatttagctgcgtcacgatctctcttggggttttgggggggtccctgacactctcctgtgcagcctctggattcacagtcagcagcaatgccatgagttgggtccgccaggctccgagggaaggggttgcagtgggtctcggggattggaagtgatgggtgccacacactacgcagactccgtgagggcnttcatcatctccagagacgattaccgaaaacacagtgaatctgacaaatgtacagcctcagcgccgaggacacggccgtctacttctgtgacgaaagacctctagttttgggccgcggccgacctacgtggggccaggccaaccctggtcaccgtctcttcacgccctcaccacggcccagtccggtccttccccgtggcccgccctcgcctccgagcgctacccncggagcgcacgagccgccgtggcctcgcctggtccaaggctcttccacgcgtangttcgttgacgcgggctggcaggccgaagngn

SEQ ID NO: 356272 - DNA, 583 bp, Homo sapiens
  misc_feature: GZ8MTXP01CXEGO.22.36.D03.1.454.CMB.2.raw
  modified_base (328)..(328): a, c, t, g, unknown or other
  misc_feature (328)..(328): n is a, c, g, or t
tcagacatacgcgtcacgaccggtgctcgatttagctgcgtcacgatctctcttggggtggggtctcaggaggcagcgctctcgggacgtctccaccatggcctgggctttgctattcctcaccttcctcactcagggcacagggtcctgggcccagtctgccctgaccccagcctgcctccgtgtctggatcatctggacagtcgatcagcattcctgcactgggaccaacagtgacattgggtcttttgactctgtctcctggtaccaacaacacccaggaccaaaccccccaactcatcatttatggtgtcactcgtcggccctnaggagtctctccatcgcttctcaacggctccaaagtctggacaacacggccctaccctaaccactctctcgggcctccgtaagtttgaggatgagtcttacttagttactgtctagtttacccttaaagttacggcctcctaacgttccgttcgttcggtttcggcggtaaggtccaaccggtagttcggtacccgtccgttcgggttcacgtcccaacgggtcctccgcccccgttggtcccttaacgttcccg

SEQ ID NO: 356273 - DNA, 562 bp, Homo sapiens
  misc_feature: GZ8MTXP01D0WIN.22.36.D03.1.454.CMB.2.raw
  modified_base (403)..(403): a, c, t, g, unknown or other
  misc_feature (403)..(403): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctcctgtgcagcctctggattcacagtcagcagcaatgccatgagttgggtccgtcgaggctccgaagggggaagggggttgcgaggtgggtcgtcgggggattggaagtgagtggtgccacacaactacgcagacctccggtggacgggggcccgnttcatcatctccagagaacgacttaccgaaaacacagtagaatctaggacaaatgtaacacgcctcgagccgccgaggacgacggccgtctacttctgttcgacgaacgccgttcttacgttttcgggccgcggccgacgttacgtcgggccgaacggg

SEQ ID NO: 356274 - DNA, 515 bp, Homo sapiens
  misc_feature: GZ8MTXP01A80PQ.22.36.D03.1.454.CMB.2.raw
  modified_base (362)..(362): a, c, t, g, unknown or other
  misc_feature (362)..(362): n is a, c, g, or t
  modified_base (510)..(510): a, c, t, g, unknown or other
  misc_feature (510)..(510): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctggtaccaacaacacccaggccaaaccccccatcatcatttatgtgtcactcgtcggccctcagagtctcctcatcgcttctcaggctcaagtctggcaacncgcctccctaacatctctgggctccagtttgaggacgagtctacttattacgtgctagttaccttaaattagcgtcactctcgtggtttcggcggaagcacgaagttgaccgtcttcggttcacgcccaggcctcgccccttcggtcnctccg

SEQ ID NO: 356275 - DNA, 607 bp, Homo sapiens
  misc_feature: GZ8MTXP01ELAVF.22.36.D03.1.454.CMB.2.raw
  modified_base (300)..(300): a, c, t, g, unknown or other
  misc_feature (300)..(300): n is a, c, g, or t
  modified_base (318)..(318): a, c, t, g, unknown or other
  misc_feature (318)..(318): n is a, c, g, or t
  modified_base (352)..(352): a, c, t, g, unknown or other
  misc_feature (352)..(352): n is a, c, g, or t
  modified_base (394)..(394): a, c, t, g, unknown or other
  misc_feature (394)..(394): n is a, c, g, or t
  modified_base (430)..(430): a, c, t, g, unknown or other
  misc_feature (430)..(430): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggctaattttaaaaggtgtcaagtgtgcggtgaaggtattggagtcgtgggggagcttggtacaggccggggggtcctgacactctcctgtgcagcctctggattcacagtcagcagcaatgccatgagttggccncaggctcgagggagggtncgagtgggtctgggggattggaagtgagtgggtncccacacaacgtacgcagtaccgtccggtaggacgggggccnttcgatcatctcagagacgactacgaaacacagtanaatctagggactaaagtcgtaacacgccctacgacggaccgaccggaacgggaccgaaccggcccggtaacctaacgttcgtcgttacgaccggtaaacgttacccgttcgttaacggttttccggggcccgtccgggtacccgacgttaccggttccgggggccgtaacccggggg

SEQ ID NO: 356276 - DNA, 557 bp, Homo sapiens
  misc_feature: GZ8MTXP01D5ZF4.22.36.D03.1.454.CMB.2.raw
  modified_base (216)..(216): a, c, t, g, unknown or other
  misc_feature (216)..(216): n is a, c, g, or t
  modified_base (347)..(347): a, c, t, g, unknown or other
  misc_feature (347)..(347): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacatttgggtcttttgactctgtctcctggtaccaacaacacccaggaccaaaccccccaatcatcatttatggtgtcactcgtcggccctcaggagtctctccatcgcttcncaaggctccaagtctggcaacacggcctccctaacatctctgggcctccagtttgaggacgagtctacttattactgggactagtttacctttaaaagttcggaccgcctaacttcttcggttggttttcggcggtaggcaccgaaggtcgacccgtcgtcggttcgcgcccgaaggccttcgccccctcggttcaaccgttcttccccg

SEQ ID NO: 356277 - DNA, 553 bp, Homo sapiens
  misc_feature: GZ8MTXP01D8RI5.22.36.D03.1.454.CMB.2.raw
  modified_base (490)..(490): a, c, t, g, unknown or other
  misc_feature (490)..(490): n is a, c, g, or t
  modified_base (547)..(547): a, c, t, g, unknown or other
  misc_feature (547)..(547): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctcctggtaccaacaacaccccaggaccaaacccccccaatcatcatttatggtgtcactcgtcggccctcaggagtctctcatcgcttctcaggctccaaagtctggcaacgaccgtccctaccctaaccatcctcgtgggccttacccgtagttttgacggtacgagtctaactttattactgtctagtttacctttaaatacggcacctacttctcgttggtttcggngggaagcacgaagttcgaccgtcttcgttcacgcccaggtctcggccccttggtccncgttcc

SEQ ID NO: 356278 - DNA, 535 bp, Homo sapiens
  misc_feature: GZ8MTXP01AE7HU.22.36.D03.1.454.CMB.2.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (306)..(306): a, c, t, g, unknown or other
  misc_feature (306)..(306): n is a, c, g, or t
  modified_base (367)..(367): a, c, t, g, unknown or other
  misc_feature (367)..(367): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaanagtgacattgggtcttttgactctgtctcctggtaccaacaacacccaggcaaaccccccaactcatcatttanggtgtcactcgtcggccctcaggagtctcctcatcgcttctcaggctcaagtctggcaacncgcctccctaacatctctgggctccagtttgaaggacgagtctacttattactgctagtttaccctttaaattggcgtccacttcttcgtggttttcggcggaaggcaccgaagttcgaccgttcttcgggttcacgtcccaaggctcgccccttcggtcaacgttcc

SEQ ID NO: 356279 - DNA, 530 bp, Homo sapiens
  misc_feature: GZ8MTXP01DYB4W.22.36.D03.1.454.CMB.2.raw
  modified_base (218)..(218): a, c, t, g, unknown or other
  misc_feature (218)..(218): n is a, c, g, or t
  modified_base (345)..(345): a, c, t, g, unknown or other
  misc_feature (345)..(345): n is a, c, g, or t
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
  modified_base (440)..(440): a, c, t, g, unknown or other
  misc_feature (440)..(440): n is a, c, g, or t
  modified_base (462)..(462): a, c, t, g, unknown or other
  misc_feature (462)..(462): n is a, c, g, or t
  modified_base (523)..(523): a, c, t, g, unknown or other
  misc_feature (523)..(523): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgactattgggtctttgactctgtctctggtaccaacaacacccaggccaaaccccccaatcatcatttatgtgtcactcgtcggccctcaggagtctcctcatcgcttcncagctcaagtctgcaacncgcctccctaacatctntcggctccagtttgaggacgagtctacttattactgtctaagttacctttaaagtacgcncctacttcgtcgttggtttcgnggtaacgcacgtaagttcgaccgtccgttcgttcacgccacggtctcgccccttcggtccncttcccg

SEQ ID NO: 356280 - DNA, 566 bp, Homo sapiens
  misc_feature: GZ8MTXP01AUKTQ.22.36.D03.1.454.CMB.2.raw
  modified_base (565)..(565): a, c, t, g, unknown or other
  misc_feature (565)..(565): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgagggaaggggttgcaggtgggtctcggggattggaagtgatggtgccacacactacgcagactccgtggaggggccgcttcatcatctccagagacgattaccgaaaacacagtgaatctgacaaatgtacagcctcagcgccgaggacacggccgtctacttctgtgacgaaagacctcttagtttttcgggccgcggccgacctacgtggggccagggcaacccgtggtcaccgtctcttcacgccctccaccgacgggcccacgtccggtccttcccccgtcggccgccctgcctccgacggacgccacccgtccgggagacgccacgacgccggcccgtgggcctcgcccgtggtccaacgggcctaaccgttcccgacgcgtatcgttcgttgacggcgggctggcgaggcgcaagng

SEQ ID NO: 356281 - DNA, 634 bp, Homo sapiens
  misc_feature: GZ8MTXP01AXDK1.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaaccaacagtgactagttgggtctttgactctgtctcctgtaccaacacacccagaccaaacccccatcatcatttatgtgtcactcgtcggtccctcgagacgtctcctcatcgtcttctacacggtcctccaaagtctcggaccaacgaccgccctaccctaacactctcgtcgggcctaccgtagtttagacggtacgtacgttacttacttacttacgtgtaccttaacgtttaccctttaaagttcgccgtacctacttccgttcgggtttcgggttttccgggcgggtaacggtaccttaccggtaaacggttccggtacccggttccgttccggttccgacccggaacccggtaaggtcccgttcccggcccccgttcgggtaacccttcctttccccg

SEQ ID NO: 356282 - DNA, 554 bp, Homo sapiens
  misc_feature: GZ8MTXP01DP3W8.22.36.D03.1.454.CMB.2.raw
  modified_base (299)..(299): a, c, t, g, unknown or other
  misc_feature (299)..(299): n is a, c, g, or t
  modified_base (318)..(318): a, c, t, g, unknown or other
  misc_feature (318)..(318): n is a, c, g, or t
  modified_base (360)..(360): a, c, t, g, unknown or other
  misc_feature (360)..(360): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggagcttggtacaggccggggggtcctgacactctcctgtgcagcctctggattcacagtcagcagcaatgccatgagttggccncaggctcgagggagggttncgaggtgggtcgtcgggggattgggaagtgagtggtcgccanacaactacgcagacctccggtgacgggggcctcttcatcatctcagacgacgattaccgaaacacagtagaatctaggacaaatgtaacagcctcgacgcgccgacggacacggccgtctacttctcgttgacgtaacgaccttcgttacgttttcgggccgtccggccgacgttacggtcgggccgaaccggg

SEQ ID NO: 356283 - DNA, 573 bp, Homo sapiens
  misc_feature: GZ8MTXP01A8PWW.22.36.D03.1.454.CMB.2.raw
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctcctgtgcagcctctggattcacagtcagcagcaatgccatgagttggccncaggctccgaggggaagggttgcgaggtgggtcgtcgggggattgggaagtgagtgggtcncccaacacacgtacgcagaccgtccggtggacggggccgcttcgactcactctaccagacgacactaccgaaacacgaggtagaatctagacaaagtcgtaacacgcctcgacgccgccggaacggaccgacgggtcccttcgtaccttccgttggttcgacgaaacgtccctcgtttacgtttcgggaccgtccgggccgtaacccg

SEQ ID NO: 356284 - DNA, 537 bp, Homo sapiens
  misc_feature: GZ8MTXP01CIQVJ.22.36.D03.1.454.CMB.2.raw
  modified_base (218)..(218): a, c, t, g, unknown or other
  misc_feature (218)..(218): n is a, c, g, or t
  modified_base (359)..(359): a, c, t, g, unknown or other
  misc_feature (359)..(359): n is a, c, g, or t
  modified_base (452)..(452): a, c, t, g, unknown or other
  misc_feature (452)..(452): n is a, c, g, or t
  modified_base (528)..(528): a, c, t, g, unknown or other
  misc_feature (528)..(528): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtctttgactctgtctcctggtaccaacaacacccaggcaaacccccatcatcattatgtgtcactcgtcggcctcaggagtctctcatcgcttctcaggctcaagtctggcaacncgcctcctaacatctctggctccagttgagcgagtctacttattactgtctagttccttaaattggctcgtacttctcgttgggttttccggnggtcggtcaccggtaaacgttggaacccgttccgttccggttcacgcccaaggtcctcgcccccttcgggtaaccncgtttcccg

SEQ ID NO: 356285 - DNA, 574 bp, Homo sapiens
  misc_feature: GZ8MTXP01DRHME.22.36.D03.1.454.CMB.2.raw
  modified_base (373)..(373): a, c, t, g, unknown or other
  misc_feature (373)..(373): n is a, c, g, or t
  modified_base (399)..(399): a, c, t, g, unknown or other
  misc_feature (399)..(399): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggctttgcttgtggctatttaaaaggtgtcaagtgtgcggtgaaggtattggagtcgtgggggagcttggtacaggccggggggtccctgacactctcctgttcagcctctggattcacagtcagcagcaaatgccatgagttggtccgccaggctccgagggggaaggggttgcgaggtgggtcgtcgggggattgggaagtgagtggtgaccacncactacgcagactcggtgaggggccncttcatcatctaccagagacgattaccgaaaacacagtaggaaatctagacaaaatcgtaacagccctacacgcgcgaggaacggacgaccggtcccttacgttaccgttcgttcgttcgaacgtaaacgtaccttaacgttacggtttcgggacccgtccggttaaccgtaacg

SEQ ID NO: 356286 - DNA, 584 bp, Homo sapiens
  misc_feature: GZ8MTXP01BS1DU.22.36.D03.1.454.CMB.2.raw
  modified_base (344)..(344): a, c, t, g, unknown or other
  misc_feature (344)..(344): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgtcctgacccagcctgcctccgtgtctggatcatctggacagtcgatcagcatttcctgcactgggaccaacagtgacattgggtctttgactctgtctcctggtaccaacaacacccagaccaaaccccccatcatcatttatggtgtcactcgtcggccctcaggagtctctccatcgcttcncaacggctccaagtctggaccaaccgacggccctacccctaacctactcctcgtcgggcctccgtaggtttgaggtacgagttcctaacttattactggtacttagtttacctttaaagttacgccgtcctacttccgttcggttcgggttttcggcggtaggtccgacgttaagtcgacccgtccgtcggttcgcgcccgaaggtcctccgcccccgtcggttcctccttccgttcccg

SEQ ID NO: 356287 - DNA, 532 bp, Homo sapiens
  misc_feature: GZ8MTXP01AX7U6.22.36.D03.1.454.CMB.2.raw
  modified_base (311)..(311): a, c, t, g, unknown or other
  misc_feature (311)..(311): n is a, c, g, or t
  modified_base (370)..(370): a, c, t, g, unknown or other
  misc_feature (370)..(370): n is a, c, g, or t
  modified_base (527)..(527): a, c, t, g, unknown or other
  misc_feature (527)..(527): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggaccaaaccccccaatcatcatttatggtntcactcgtcggccctcaggagtctcctcatcgcttctcaggctaccaagtctggcaacncgccctccctaacatctctgggctccgagtttgaggacgagtctacttattacgtgtctaagtttcctttaaaatacggcacctactctcgttggttttcggcggaaggcacggaagttgaccgtcttcggttcagcccaggctcgccccttggtcncgtcc

SEQ ID NO: 356288 - DNA, 584 bp, Homo sapiens
  misc_feature: GZ8MTXP01E4NA4.22.36.D03.1.454.CMB.2.raw
  modified_base (220)..(220): a, c, t, g, unknown or other
  misc_feature (220)..(220): n is a, c, g, or t
  modified_base (251)..(251): a, c, t, g, unknown or other
  misc_feature (251)..(251): n is a, c, g, or t
  modified_base (448)..(448): a, c, t, g, unknown or other
  misc_feature (448)..(448): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgaggggaaggggttgcagtgggtctcggggattggaagtgatggtgccacacactacgcagactccgtggaggggccnttcatcatctccagagacattaccgaaaacncagtgaatctgacaaatgtacagcctcagcgccgaggacacggccgtctactctgtgacgaaagacctcttagtttttcggggccgcggccgaccgtacgtggggccagggcaacccgtggtcaccgtctcttcagccctccaccgaacgggcccatccgggtccttcccccgtggcccgccctgcctccgaggacncaccgtccgggagacgccacgacggccggccccgtggggcctcggtcccgttcggaccgaaacgggcccttaccttcccgaacgttcgtacgtgttaccgttgacgggccgggctcgggcgaaggcgtcaagtaag

SEQ ID NO: 356289 - DNA, 556 bp, Homo sapiens
  misc_feature: GZ8MTXP01BM486.22.36.D03.1.454.CMB.2.raw
  modified_base (339)..(339): a, c, t, g, unknown or other
  misc_feature (339)..(339): n is a, c, g, or t
  modified_base (464)..(464): a, c, t, g, unknown or other
  misc_feature (464)..(464): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttggtacgaggccgggggggtccctgacactctcctgtgcagcctctggattcacagtcagcagcaatgccatgagttggggcccgccaggcctccgagggggaagggggttncgaggtgggtcgtcgggggatttggggaagtggatgggtacgcccaacacactacgcagactccggtaggacggggccgcgttcatcactctccagacgacgatacgaaacacaggtagaattcngacaaatcgtacacgcctcagcgccgaaggacacggccgttctactcttgttcgacgaatctcgttacgtttcgggccgtcggcccgtaacg

SEQ ID NO: 356290 - DNA, 681 bp, Homo sapiens
  misc_feature: GZ8MTXP01A9CJV.22.36.D03.1.454.CMB.2.raw
  modified_base (310)..(310): a, c, t, g, unknown or other
  misc_feature (310)..(310): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcattcctgcactgggaccaacagtgactattgggtctttgactctgtctcctggtaccaacaacacccacggaccaaaccccccatcatcatttatggtntcactcgtcgcctcaggagtctcctcatcgcttctacaggcctaccaagtcctcgggaccaaccgacgggtcccctacccgtaaaccctattccgtccgtcgggccttacccgaggttttcgaacgggtacgtacgttccttaactttactttacggtacgtaccgttaacgtttaccctttaaagttcgggtaccgtcccgtaacgttccgttccggtttggttttaccgggcgggtaacggtcccgttaaaccgggtaaacggttcgggtaaaccccgttccgttacccgggttccaaccgggtcccccgtaaagggtccccgttcccgggtaccccccgtttcgggtaaccccttaacgtttcccccg

SEQ ID NO: 356291 - DNA, 565 bp, Homo sapiens
  misc_feature: GZ8MTXP01A1QZM.22.36.D03.1.454.CMB.2.raw
  modified_base (366)..(366): a, c, t, g, unknown or other
  misc_feature (366)..(366): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctctggtaccaacaacacccaggaccaaaccccccaactcatcatttatgcgtcactcgtcggccctcagacgtctcctcatcgcttctcagctcaagtctggcaacncgcctccctaacatctctgggctccagtttgaggacgagtctacttattacgtgtactagttaccctttaaattcggcgtcctactcgttcggttggttttccgggcggtaacggcttaccggaaagttcgacccgttccgttcgggttccacggtccccaaggtcccgttcggcccccttcgggtcccaaccttcccg

SEQ ID NO: 356292 - DNA, 531 bp, Homo sapiens
  misc_feature: GZ8MTXP01AQJK7.22.36.D03.1.454.CMB.2.raw
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (343)..(343): a, c, t, g, unknown or other
  misc_feature (343)..(343): n is a, c, g, or t
  modified_base (364)..(364): a, c, t, g, unknown or other
  misc_feature (364)..(364): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcattcctgcactgggaccaacagtgacattgggtctttgactctgtctcctggtaccaacaacacccaggccaaaccccccaatcatcatttangtntcactcgtcggccctcagagtctcctcatcgcttcncaggctcaaagtctggcaacncgccctcctaacatctctcgggctccagtttgaggacgagtctaacttatacgtgctagttacctttaaatacgcgtcctactcttcgtggtttcggcggtaaggcaccggtaagttcgaccgtccttcggttcacgtcccaggcctcgcccttcggtcaacgtccg

SEQ ID NO: 356293 - DNA, 568 bp, Homo sapiens
  misc_feature: GZ8MTXP01DF38I.22.36.D03.1.454.CMB.2.raw
  modified_base (304)..(304): a, c, t, g, unknown or other
  misc_feature (304)..(304): n is a, c, g, or t
  modified_base (401)..(401): a, c, t, g, unknown or other
  misc_feature (401)..(401): n is a, c, g, or t
  modified_base (415)..(415): a, c, t, g, unknown or other
  misc_feature (415)..(415): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaaggtgtcaagtgtgcggtgaaggtattggagtcgtgggggaggcttgggtacaggccggggggtccctgacactctcctgtgcagcctctggattcacagtcagcagcaaatgccatgagttggccnccaggctccgagggaagggtgcgaggtgggctgggggattggaagtgacgtggtgccaacacgaactacgcaagacctcccggtaggacgggggccncttcattcaattcnccagaacgaacgtacttaaccgaaaaccaanagtanaatcagacaatagtacacncncgacgacgacgacgacgaccgcgtctacttctcgcgacgtaacttacgttcgttacgtttcggtccggccggccgacgttacgtcgggcggaacgg

SEQ ID NO: 356294 - DNA, 611 bp, Homo sapiens
  misc_feature: GZ8MTXP01DSOJ1.22.36.D03.1.454.CMB.2.raw
  modified_base (222)..(222): a, c, t, g, unknown or other
  misc_feature (222)..(222): n is a, c, g, or t
  modified_base (447)..(447): a, c, t, g, unknown or other
  misc_feature (447)..(447): n is a, c, g, or t
tcagacatacgcgtcacgaccggtgctcgatttagctgcgtcacgatctctcttggggttttggggggggtccctgacactctcctgtgcagcctctggattcacagtcagcagcaatgccatgagttgggtccgccaggctccgaggggaaggggttgcagtgggtctcggggattggaagtgatggtgccacacactacgcagactccgtggaggggccncttcatcatctccagagacgattaccgaaaacacagtgaatctagacaaatgtacagcctcagcgcgaggacacggccgtctacttctgtgacgaaagtacctcttagtttttcgggccgcggccgacctacgtggggccagggccaacccgtggtcaccgtctcttcacgcctcaccacgggccacgtcgtccttcccctggccgccctgcctccgacgggacnccgaaccccgtccgggaacgacgccgaccgacggcccgggtccccgtcggggtccgtcggtcccgtcgggtaccaaacgggtaaccttaacgtttcccgaaccggttcgttaacgtcggttacgttggacgggccggggtacctgggaccagggttcgcaagtg

SEQ ID NO: 356295 - DNA, 553 bp, Homo sapiens
  misc_feature: GZ8MTXP01CJYU3.22.36.D03.1.454.CMB.2.raw
  modified_base (357)..(357): a, c, t, g, unknown or other
  misc_feature (357)..(357): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagtggccgcaggctcgagggagggtgcgagtgggctcggggattgggaagtgatggtacnccaacgacacgtacgcagacctccggtggacggggccgcgttcactcatctcagagacgataccgaaacacaggtagaatctagacaaatgtacacgcctcagccgccggaacggaccgacggccgttctaacttcgttcgttcgacgaaacgtaccttcgttaagtttttcggggactaacggccggtaacccgg

SEQ ID NO: 356296 - DNA, 612 bp, Homo sapiens
  misc_feature: GZ8MTXP01BREU8.22.36.D03.1.454.CMB.2.raw
  modified_base (218)..(218): a, c, t, g, unknown or other
  misc_feature (218)..(218): n is a, c, g, or t
  modified_base (251)..(251): a, c, t, g, unknown or other
  misc_feature (251)..(251): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtggaggggccncttcatcatctccagagacgattaccgaaaacncagtgaatctgacaaatgtacagcctcagccgccgaggacacggccgtctacttctgtgacgaaagccttcttagtttttcgggccgcgggccgaaccgtacgtcggggacccgagggccctaaacccgtggtccacccggttctccgtttccacgtccctacccacccgaacgggccccagttccggtcccttcccccgtggccccgcccttcgcctccgaggcaccaccctcgggacgacgccacgacggcccgcccgtgggcctcgtcccgttggtaccgaagggtaacccttacttcccgaacgttccgtagttcgttaccgttggacggtcggggctgggccgaaggcgtcaagtg

SEQ ID NO: 356297 - DNA, 543 bp, Homo sapiens
  misc_feature: GZ8MTXP01E2SU9.22.36.D03.1.454.CMB.2.raw
  modified_base (301)..(301): a, c, t, g, unknown or other
  misc_feature (301)..(301): n is a, c, g, or t
  modified_base (320)..(320): a, c, t, g, unknown or other
  misc_feature (320)..(320): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcttggtacaggccggggggtccctgacactctcctgtgcagcctctggattcacagtcagcagcaatgccatgagttggccncaggctcgagggaagggtncgagtgggtcgtgggggattgggaagtgatggtgccacacaactacgcagactccgtggacggggccgctcatcatctccagagacgataccgaaaacacagtagaatctaggacaaatacgtacacgcctcagcgccgagacgacgccgtctacttctgttgacgtaaagaccgttcttacgttttcgggccgtcggccgacgttacgtcgggccgaacggg

SEQ ID NO: 356298 - DNA, 540 bp, Homo sapiens
  misc_feature: GZ8MTXP01ANVKD.22.36.D03.1.454.CMB.2.raw
  modified_base (359)..(359): a, c, t, g, unknown or other
  misc_feature (359)..(359): n is a, c, g, or t
  modified_base (364)..(364): a, c, t, g, unknown or other
  misc_feature (364)..(364): n is a, c, g, or t
  modified_base (394)..(394): a, c, t, g, unknown or other
  misc_feature (394)..(394): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (484)..(484): a, c, t, g, unknown or other
  misc_feature (484)..(484): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttgggtccgccaggctccgagggggaaggggttgcaggtgggtctcgggggattggaagtgatggngccanacaactacgcagacctccgtgacggggccncttcatcatctccagagacgatccgaaaacnagtanatcagacaaatcgacncgccncacgcgccgacgacgaccgccgtctcttctcgngacgaacgacgttcttacgtttcggtccggccggccgacgttacgtcgggcggcgg

SEQ ID NO: 356299 - DNA, 588 bp, Homo sapiens
  misc_feature: GZ8MTXP01AKE6G.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggagcttggtacgaggccggggggtccctgacactctcctgtgcagcctctggattcacagtcagcagcaatgccatgagttgggccgccaggctcgaggggaaggggttgcgaggtgggtcgtcggggattggaagtgatggtgccacacaactacgcagacctccggtggacggggccgcttcatcatctccagacgacgacttaccgaaaacacagtagaatctaggacaaagtcgtaacacgcctcacggaccgccgacggaccgaccggcccggtctaccgttctcggttcgaccgaaacgttacccgttcgttacgtttttcggggacccgtccggcccggacgttaccggtcggggcccgtaaccgggg

SEQ ID NO: 356300 - DNA, 556 bp, Homo sapiens
  misc_feature: GZ8MTXP01B7S50.22.36.D03.1.454.CMB.2.raw
  modified_base (361)..(361): a, c, t, g, unknown or other
  misc_feature (361)..(361): n is a, c, g, or t
  modified_base (469)..(469): a, c, t, g, unknown or other
  misc_feature (469)..(469): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatgccatgagttgggtccgccaggctccgaggggaagggggttgcgaggtgggtctcgggggattggaagtgatgggtnccacacaactacgcagacctccggtgacggggccgcttcatcatctcagagacgattaccgaaacacagtagaatctaggacaaatgtacagccctcgacgccgccgnggaccaccggccgtctacttctgttcgacgaacgccgttcttagttttcgggccgtccggccgacgttacgtcggggccgaaccggg

SEQ ID NO: 356301 - DNA, 580 bp, Homo sapiens
  misc_feature: GZ8MTXP01DX41P.22.36.D03.1.454.CMB.2.raw
  modified_base (218)..(218): a, c, t, g, unknown or other
  misc_feature (218)..(218): n is a, c, g, or t
  modified_base (468)..(468): a, c, t, g, unknown or other
  misc_feature (468)..(468): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgccctccgtgtctggatcatctggacagtcgatcagcatttccngcactgggaccaacagtgactatttgggtcttttgactctgtctcctggtaccaacaacacccacggaccaaacccccactcactctattatgtgtcactcgtccgcctcaggacgtctctccatcgtctctcaacgctcctatcgtcgacaacaccggcctacccctaaccatctcgtcgggtcctccgtagttgaggtacgacgttcttacttacttactcgtctagtttaccttaacgttaggtccncgtacctacgttcgttcgggtttcggtcggcggtaactaccgaggtcgttacccgtccgtcggttacgcgacccgaacggctccgtccccgtcgttactccgttcttccccg

SEQ ID NO: 356302 - DNA, 552 bp, Homo sapiens
  misc_feature: GZ8MTXP01BYHI1.22.36.D03.1.454.CMB.2.raw
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatgccatgagttggccncaggctccgagggagggttncgaggtgggtcgtggggattgggaagtgagtggtgccacacaactacgcagactccgtgacggggcctctcatcatctccagacgacgattaccgaaacacagtgatactaggacaaatgtacagcctcgacgcgccgacggacaccggccgtctacttctcgttcgacgaacgttaccgttcgttacgttttcgggccgtccgacgccgttactaaccggttcgggtcccgg

SEQ ID NO: 356303 - DNA, 599 bp, Homo sapiens
  misc_feature: GZ8MTXP01AW1OA.22.36.D03.1.454.CMB.2.raw
  modified_base (271)..(271): a, c, t, g, unknown or other
  misc_feature (271)..(271): n is a, c, g, or t
  modified_base (330)..(330): a, c, t, g, unknown or other
  misc_feature (330)..(330): n is a, c, g, or t
  modified_base (448)..(448): a, c, t, g, unknown or other
  misc_feature (448)..(448): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctcctgtgcagcctctggattcacngtcagcagcaatgccatggagttcgggccgccgaggcctccggagggggtaaggggttncgaggtggggtctcgggggattgggaagtgagtggtgccacacaactacgcagacctccggtgggacggggccctcttcatcactctccagagaacgacttaaccgaaacacacgtanaactactacggactaaagtcgtaacacgccctcgacgaccgccggacggaccgaccggtccgtcctaacgttcgtcgttcgtaccgaaacgttaccgttcttacgttttcgggccggtccggcgtaccgttaccgtcggggccgtaacggg

SEQ ID NO: 356304 - DNA, 629 bp, Homo sapiens
  misc_feature: GZ8MTXP01DSEUN.22.36.D03.1.454.CMB.2.raw
  modified_base (300)..(300): a, c, t, g, unknown or other
  misc_feature (300)..(300): n is a, c, g, or t
  modified_base (388)..(388): a, c, t, g, unknown or other
  misc_feature (388)..(388): n is a, c, g, or t
  modified_base (400)..(400): a, c, t, g, unknown or other
  misc_feature (400)..(400): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccggggggtccctgacactctcctgtgcagcctctggattcacagtcagcagcaatgcatgagttggccncgaggctccgaggggaagggttgcgagggtgggtcgtcgggggattgggaagtgagtggtgccaacacaactacgcagtccgtccggnggacgggggccncttcactcatctcagacgacgacttaccgaaacacgagtagaatctaggaacaaatcgtaacgacgccctcgacggaccgaccggtaacgggaccgacccgggtcccgttaacgttacgtttccgtggttacgtacggtaaacgttaccgtttccgtttacggtttttccggggcccggtccgggtcccggtaccgttaccgggttcgggggaacccgtaacccggggg

SEQ ID NO: 356305 - DNA, 564 bp, Homo sapiens
  misc_feature: GZ8MTXP01C19V7.22.36.D03.1.454.CMB.2.raw
  modified_base (219)..(219): a, c, t, g, unknown or other
  misc_feature (219)..(219): n is a, c, g, or t
  modified_base (251)..(251): a, c, t, g, unknown or other
  misc_feature (251)..(251): n is a, c, g, or t
  modified_base (557)..(557): a, c, t, g, unknown or other
  misc_feature (557)..(557): n is a, c, g, or t
  modified_base (560)..(560): a, c, t, g, unknown or other
  misc_feature (560)..(560): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgagggaaggggttgcaggtgggtctcggggattggaagtgatggtgccacacactacgcagactccgtgaggggccnttcatcatctccagagacgattaccgaaaacncagtgaatctgcaaatgtacagcctcagcgcgaggacacggccgtctacttctgtgacgaaagtacctcttagtttttcgggccgcggccgacctacgtcggggccaggggcaacccgtgtcaccgtctcttcacgcctccaccgaacgggcccagtccggtccttcccccgtggcccgcccctgcctccgacggacgccaacccgtccgggacgacgccacgacgcccggcccgtgggcctgcccgtggtccaaggaacctcttccgacgcgtatcgttcgttgacggcgggctcgggcagggcncgngaag

SEQ ID NO: 356306 - DNA, 636 bp, Homo sapiens
  misc_feature: GZ8MTXP01BLY30.22.36.D03.1.454.CMB.2.raw
  modified_base (465)..(465): a, c, t, g, unknown or other
  misc_feature (465)..(465): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcttggtacgaggccggggggtcctgacactctcctgtgcagcctctggattcacagtcagcagcaatgccatgagttggccgcaggctccgagggggaagggttgcgaggtgggtctcgggggattgggaagtgagtggtcgacccaacgacacgtacgcaacggaccgtccggtggacggggcccgcgttcacgtccatctacccgagacgacgtacttaaccgaaaacacgagggtanaatcagacaaagtcgtacaacgcctacgacgccggccggaacgggaaccgacccgggtacccgttaccgttaaccgtttccttacgggttcggaccggtaaaacgtaccccgtttaacgtttaacggttttttccggggccccggtccgggttaaccccggttaacccggg

SEQ ID NO: 356307 - DNA, 531 bp, Homo sapiens
  misc_feature: GZ8MTXP01DW0RA.22.36.D03.1.454.CMB.2.raw
  modified_base (397)..(397): a, c, t, g, unknown or other
  misc_feature (397)..(397): n is a, c, g, or t
  modified_base (426)..(426): a, c, t, g, unknown or other
  misc_feature (426)..(426): n is a, c, g, or t
tcagacatacgcgtcacgaccggtgctcgatttagctgcgtcacgatctctcttggggagctctgagagaggagcccagccctgggattttcaggttgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatgccatgagttggccgcaggctccgaggggaaggggttgcgagtgggtctcgggggattgggaagtgatggtgccaacgacactacggcagactccgtgaggggccnttcatcatctcagagacgatacgaaaacncaggtgaatctgacaaatgtacagcctcgagccgcggaagtacacgggccttctaacgtcagttgacgaaagaccttcgttagtttcgggccgcggccgtaaccg

SEQ ID NO: 356308 - DNA, 535 bp, Homo sapiens
  misc_feature: GZ8MTXP01D5NYF.22.36.D03.1.454.CMB.2.raw
  modified_base (449)..(449): a, c, t, g, unknown or other
  misc_feature (449)..(449): n is a, c, g, or t
  modified_base (529)..(529): a, c, t, g, unknown or other
  misc_feature (529)..(529): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgctcctggtaccaacaacacccaggccaaaccccccaatcatcatttatgtgtcactcgtcggccctcaggatctcctcatcgcttctcaggctccaaagtctggcaacacgggcctaccctaacatctctgggctccagtttgaggacagtctaactttattactgtactagttaccctttaaaattcggcncctaactctcgttggttttcggcggtaagcacgagttcgaccgtcttacggttcacgcccaaggctcgccccttcggtcncttccg

SEQ ID NO: 356309 - DNA, 518 bp, Homo sapiens
  misc_feature: GZ8MTXP01C6EH8.22.36.D03.1.454.CMB.2.raw
  modified_base (217)..(217): a, c, t, g, unknown or other
  misc_feature (217)..(217): n is a, c, g, or t
  modified_base (485)..(485): a, c, t, g, unknown or other
  misc_feature (485)..(485): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgccctccgtgtctggatcatctggacagtcgatcagcatttccngcactgggaccaacagtgacattgggtcttttgactctgtctcctggtaccaacaacacccaggccaaaccccccactcatcatttatgtgtcactcgtcggccctcagagtctctccatcgcttctcaaggctccaagtctggcaacacggcctccctaacatctctgggctcagtttgaggacgagtctacttattactggctagtttcctttaaattggcgcctactctcgtgtttcggcggtagcacgagtcgaccgtctcgcncgccaaggctcgcccctggttctcgttcttccg

SEQ ID NO: 356310 - DNA, 534 bp, Homo sapiens
  misc_feature: GZ8MTXP01B1DYX.22.36.D03.1.454.CMB.2.raw
  modified_base (311)..(311): a, c, t, g, unknown or other
  misc_feature (311)..(311): n is a, c, g, or t
  modified_base (463)..(463): a, c, t, g, unknown or other
  misc_feature (463)..(463): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacgttggtggttataactatgtctcctggtaccaacaacacccaggccaaaacgcccccaaaactcatgatttangaggtcactaaagccggaccctcgacgggggtccctgactcgtcttctctggctccaagtctcggcaacacggcctccctgacccgtctcgtgggctccaggctgacgatgagctagattagtactgcagctcatttgctggccgtcctacncgttgggtcgttcgggcgggaggaccaagcgttcgacccgtctagggccacgcccgaggccttcgcccccg

SEQ ID NO: 356311 - DNA, 549 bp, Homo sapiens
  misc_feature: GZ8MTXP01A7VK4.22.36.D03.1.454.CMB.2.raw
  modified_base (378)..(378): a, c, t, g, unknown or other
  misc_feature (378)..(378): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccggggggtccctgacactctcctgtgcagcctctggattcacagtcagcagcaatgccatgagttgggccgccaggctccgagggggaagggggttgcgaggtggggtcgtcgggggattgggaagtgatgggtgcccaanacactacgcagactccggtgacggggccgcttcatcatctccagacgacgactaccgaaacacaggtagaatctagacaaatgtacacgcctcacgccgccgaacggacgacggccgttctacttcttgttcgacgaacgcctcttagtttcgggccgtcggccgtaaccg

SEQ ID NO: 356312 - DNA, 552 bp, Homo sapiens
  misc_feature: GZ8MTXP01BAEXK.22.36.D03.1.454.CMB.2.raw
  modified_base (305)..(305): a, c, t, g, unknown or other
  misc_feature (305)..(305): n is a, c, g, or t
  modified_base (328)..(328): a, c, t, g, unknown or other
  misc_feature (328)..(328): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccatcatcatttanggtgtcactcgtcggcctcaggntctctcatcgcttctcacggtctccaagtctcggactaacacggccctccctaaccactctctcgggctcctagtttgaggacgagtctacttattacgtgtctagttacctttaaagttcggcgacctacttcgtcggttggtttccggcggtaaggtccaccggtaagttcgaccgtccttcggttcacgtcccaggcctcgccccttcggtccaacgttcc

SEQ ID NO: 356313 - DNA, 519 bp, Homo sapiens
  misc_feature: GZ8MTXP01ARW6F.22.36.D03.1.454.CMB.2.raw
  modified_base (216)..(216): a, c, t, g, unknown or other
  misc_feature (216)..(216): n is a, c, g, or t
  modified_base (230)..(230): a, c, t, g, unknown or other
  misc_feature (230)..(230): n is a, c, g, or t
  modified_base (305)..(305): a, c, t, g, unknown or other
  misc_feature (305)..(305): n is a, c, g, or t
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (459)..(459): a, c, t, g, unknown or other
  misc_feature (459)..(459): n is a, c, g, or t
  modified_base (485)..(485): a, c, t, g, unknown or other
  misc_feature (485)..(485): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaanagtgacatttgggtcttttgactctgtctcctggtaccaacacaccaggcaaaccccccatcatcatttatggtntcactcgtcggccctnaggngtctctccatcgcttctcaaggctccaagtctggcaacacgcctaccctaacatctctgggctccagttgagacgacgtctacttattactggctagttcctttaaattacggctcactctcgtgtttcgcggngcaccgagtcgaccgtcctcggttcncgccctaaggctcgcccctggttcctcttcgtcg

SEQ ID NO: 356314 - DNA, 632 bp, Homo sapiens
  misc_feature: GZ8MTXP01AW1N0.22.36.D03.1.454.CMB.2.raw
  modified_base (321)..(321): a, c, t, g, unknown or other
  misc_feature (321)..(321): n is a, c, g, or t
  modified_base (357)..(357): a, c, t, g, unknown or other
  misc_feature (357)..(357): n is a, c, g, or t
  modified_base (385)..(385): a, c, t, g, unknown or other
  misc_feature (385)..(385): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagttgggctgaagtggctttgcttgtggctattttaaaggtgtcaagtgtgcggtgaaggtattggagtcgtgggggagcgttggtacgaggccggggggtccctgacactctcctgtgcagcctctggattcacagtcagcagcaatgccatgagttgggtccgcaggctccgaggggagggttncgaggtgggtcgtggggattggaagtgatggtgcancaactcgcagactcgtggacggggcctntcgatcactctcgagagacgacttaccgaaaacacagtagaactcgaggaacaaagtcgtaacgacgtccctacgaacggacccgaccggtaacggaacccgtaccgggtcccgttaacttaccggttccgtacggttacggaacccggtaaaacggttaccccgtttcgtttaacggtttttccggggaccccggtaaccgggtacccggtaccgttaccgggtcggggaacccgtaacccggggg

SEQ ID NO: 356315 - DNA, 588 bp, Homo sapiens
  misc_feature: GZ8MTXP01D3TT7.22.36.D03.1.454.CMB.2.raw
  modified_base (220)..(220): a, c, t, g, unknown or other
  misc_feature (220)..(220): n is a, c, g, or t
  modified_base (253)..(253): a, c, t, g, unknown or other
  misc_feature (253)..(253): n is a, c, g, or t
  modified_base (452)..(452): a, c, t, g, unknown or other
  misc_feature (452)..(452): n is a, c, g, or t
  modified_base (567)..(567): a, c, t, g, unknown or other
  misc_feature (567)..(567): n is a, c, g, or t
  modified_base (583)..(583): a, c, t, g, unknown or other
  misc_feature (583)..(583): n is a, c, g, or t
tcagacatacgcgtcacgaccggtgctcgatttagctgcgtcacgatctctcttggggttttgggggggtccctgacactctcctgtgcagcctctggattcacagtcagcagcaatgccatgagttgggtccgccaggctccgaggggaaggggttgcagtgggtctcggggattggaagtgatggtgccacacactacgcagactccgtggagggccncttcatcatctccagagacgattaccgaaaacnagtgaatctgacaaatgtacagcctcagcgcgaggacacggcctctacttctgtgacgaaagacctcttagtttttcgggccgcggccgaccgtacgtcggggcccgagggccaaccccgtggtccaccgtctcttcacgcctccacgaacgggcccagtccggtccttcccccgtggccgcccgtgccgtccaggacnccgacccgtccgggaagcggccaacgcggcccggcccgtcgggcctcggtacccgtggtaccgaacgggaacctaccgttccgaacgttcgtactgttccgttgacggcgggtcngggacagggcgaacgngtaag

SEQ ID NO: 356316 - DNA, 619 bp, Homo sapiens
  misc_feature: GZ8MTXP01CXCAY.22.36.D03.1.454.CMB.2.raw
  modified_base (309)..(309): a, c, t, g, unknown or other
  misc_feature (309)..(309): n is a, c, g, or t
  modified_base (383)..(383): a, c, t, g, unknown or other
  misc_feature (383)..(383): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggtcgttggtacgagggccggggggtccctgacactctcctgtgcagcctctggattcacagtcagcagcaatgccatggagttgggcccncgaggcctccggaagggggtaagggggttgcgagggttggggtcgtcgggggatttgggaagttgacgttgggngcccaacacaacctacggcaagaccgttcccggtgggacgggggccctcgttcactcactctcaagacgaacgtaacttaccgaaaacacgaagtagaactctaggacaaatcgtaacacgcctcgacgccgccgaacggaccgaccggccgtcgttacttcgtcgcgacgtaacgttacccttcgttacgttttcgggaccgtccggccgacgttacgtcggggccgtaaccggg

SEQ ID NO: 356317 - DNA, 661 bp, Homo sapiens
  misc_feature: GZ8MTXP01C55C5.22.36.D03.1.454.CMB.2.raw
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (249)..(249): a, c, t, g, unknown or other
  misc_feature (249)..(249): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccgagggaagggttgcaggtgggtctcggggattggaagtgatggtgccacacactacgcagactccgtgagggccncttnatcatctcagagacgattaccgaaaancagtgaatctgacaaatgtacagcctcagcgccgaggacacggccgtctacttctgtgacgaaagtacctcttagttttcgggcccgcggacccgtacctaccggtgggggcccaaggggccaaaccccgttggtccgtacccggttctccttccgacgccctacccgaaccgaaacggggcccctacgtcccggttcccttccccccgttcgggccccgtccccttcggcccgtacccgacgggaccgccaaccccgtccggggaacgaccggaccaacgacggcccggccccgtggggccctcggtcccgtacggtaccgaaacgggtccctaaccgttcccgaccggttcgttaactcggttcgttcggacggtccggggctcgggacccaaggggccgtaacgaagtg

SEQ ID NO: 356318 - DNA, 608 bp, Homo sapiens
  misc_feature: GZ8MTXP01D69DW.22.36.D03.1.454.CMB.2.raw
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtggaggggccgcttcatcatctccagagacgattaccgaaaacacagtgaatctgacaaatgtacagcctcagcgccgaggacacggccgtctacttctgtgacgaaacgacctcttagtttttcgggccgcggccgacctacgtggggccgagggccaacccgtggtccaccgtctcttcacgcctccacacgggccagtccgtccttccccgtggccgccctgcctccgacggcgccacccgtccgggaagacgccacgacggcccggcccgtcgggcctcgcccgttacggtaccgaaacgggaaccttaccgttcccgtaacggccgttaagttcgttccgttgggaacgggccgggggtcgtcggggaccgaacgggcccggttaacgttaagtg

SEQ ID NO: 356319 - DNA, 603 bp, Homo sapiens
  misc_feature: GZ8MTXP01A4O2S.22.36.D03.1.454.CMB.2.raw
  modified_base (303)..(303): a, c, t, g, unknown or other
  misc_feature (303)..(303): n is a, c, g, or t
  modified_base (405)..(405): a, c, t, g, unknown or other
  misc_feature (405)..(405): n is a, c, g, or t
  modified_base (444)..(444): a, c, t, g, unknown or other
  misc_feature (444)..(444): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcagcctctggattcacagtcagcagcaatgccatgagttgggtccnccgaggctccgagggggaagggttgcgaggtgggtcgtcgggggtattgggaagtgagtgggtgccacgacaactacgcagacctccggtggacgggggccncttcatcatctccagagacgacttaccgaaacacagtanaatccaggactaaagtcgtaacacgccctcgacgccgccggacggaccgaccggcccgtctaccttcgtacgttcggacgtaacgttacccgttcgttacgttttcggggacccgtccgggtacccgtacgttaccggtcgggggcccgtaacccgggg

SEQ ID NO: 356320 - DNA, 551 bp, Homo sapiens
  misc_feature: GZ8MTXP01CS1CZ.22.36.D03.1.454.CMB.2.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (299)..(299): a, c, t, g, unknown or other
  misc_feature (299)..(299): n is a, c, g, or t
  modified_base (323)..(323): a, c, t, g, unknown or other
  misc_feature (323)..(323): n is a, c, g, or t
  modified_base (543)..(543): a, c, t, g, unknown or other
  misc_feature (543)..(543): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcatgggaccaacngtgactattgggtctttgactctgctctgtaccaacaacacccagccaaacccccatcatcatttanggtcgtcactcgtcggcctcaggngtctcctcatcgcttctcacgctcaagtctggcaacacgccctccaacatctctggctccagtttgacggactagtcttactttattacgtgtactagtttacctttaaagttacgcgtactacttcgtcgttcggttttcggcgggtaacgtcgacggtaacgttcgtacccgtccgttacggttcacggcccaaggtcctccgtccccgttcggtccncgttcccg

SEQ ID NO: 356321 - DNA, 519 bp, Homo sapiens
  misc_feature: GZ8MTXP01EV0GI.22.36.D03.1.454.CMB.2.raw
  modified_base (364)..(364): a, c, t, g, unknown or other
  misc_feature (364)..(364): n is a, c, g, or t
  modified_base (423)..(423): a, c, t, g, unknown or other
  misc_feature (423)..(423): n is a, c, g, or t
  modified_base (479)..(479): a, c, t, g, unknown or other
  misc_feature (479)..(479): n is a, c, g, or t
  modified_base (493)..(493): a, c, t, g, unknown or other
  misc_feature (493)..(493): n is a, c, g, or t
  modified_base (507)..(507): a, c, t, g, unknown or other
  misc_feature (507)..(507): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccggggggtccctgacactctcctgtgcagcctctggattcacagtcagcagcaatgccatgagttgggtccgccaggctccagggaaggggttgcagtgggtctcgggggattgggaagtgatggtgccncacactacgcagactcgtgaggggccgcttcatcatctccagagacgattccgaaaacncaggtcgaaatcctgcaaatgtacagcctcagcgcgaagcgacgccttcacgttcngttgcgaaagcctntattttggggcccncggttccgaacg

SEQ ID NO: 356322 - DNA, 620 bp, Homo sapiens
  misc_feature: GZ8MTXP01DNU5F.22.36.D03.1.454.CMB.2.raw
  modified_base (238)..(238): a, c, t, g, unknown or other
  misc_feature (238)..(238): n is a, c, g, or t
  modified_base (308)..(308): a, c, t, g, unknown or other
  misc_feature (308)..(308): n is a, c, g, or t
  modified_base (324)..(324): a, c, t, g, unknown or other
  misc_feature (324)..(324): n is a, c, g, or t
  modified_base (329)..(329): a, c, t, g, unknown or other
  misc_feature (329)..(329): n is a, c, g, or t
  modified_base (338)..(338): a, c, t, g, unknown or other
  misc_feature (338)..(338): n is a, c, g, or t
  modified_base (356)..(356): a, c, t, g, unknown or other
  misc_feature (356)..(356): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaaccaacagtnactagttgggtctttgactctgtctctgtaccaacacaccacgaccaaacccccaatcatcatttatgtntcactcgcgcctgagntctcncatcgctcncagctcaagtctgacacncgcctacctaacatctcgtcggctccgagtttcgagacgtagtcttaacttatacgtgtacttagtttacctttaaagtcgcgtacctacttcgttcggttgggtttccggacgggtaacggtccgaaccggtaaacggttccggtaaaccccgttccggttacccgggttcccgttaaacccgggaacccccggtaaacgggtccccgtttaccccgggcccccccgtttacgggttccccgttaacccgtttttcccccggg

SEQ ID NO: 356323 - DNA, 505 bp, Homo sapiens
  misc_feature: GZ8MTXP01APCBV.22.36.D03.1.454.CMB.2.raw
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
  modified_base (403)..(403): a, c, t, g, unknown or other
  misc_feature (403)..(403): n is a, c, g, or t
  modified_base (421)..(421): a, c, t, g, unknown or other
  misc_feature (421)..(421): n is a, c, g, or t
  modified_base (481)..(481): a, c, t, g, unknown or other
  misc_feature (481)..(481): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
tcagacatacgcgtcacgaccggtgctcgatttagctgcgtcacgatctctcttgggtttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattccgaaaacncagtgaatctgcaaatgtacagcctcagcgccgaggacacggccgtctacttctgtgcgaaagacctctatttttgggccgcggccgacctacgtggggccagggcaaccctggtcacgtctcttcagcctcaccaaggccatcgtctcccctgcncctgcctcagacgcaccnccggagacgcacagccggccctgggctgcctggtcaaggctacttccacgcgtatgttcngagcgggctggcagggccngngng

SEQ ID NO: 356324 - DNA, 583 bp, Homo sapiens
  misc_feature: GZ8MTXP01ESE8C.22.36.D03.1.454.CMB.2.raw
  modified_base (302)..(302): a, c, t, g, unknown or other
  misc_feature (302)..(302): n is a, c, g, or t
  modified_base (367)..(367): a, c, t, g, unknown or other
  misc_feature (367)..(367): n is a, c, g, or t
  modified_base (405)..(405): a, c, t, g, unknown or other
  misc_feature (405)..(405): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttgggtacaggccgggggggtccctgacactctcctgtgcagcctctggattcacagtcagcagcaatgccatgagttgggccncaggctccgagggggtaaggggttgcgagggtgggtacgtcgggggattggaagtgagtgggtcnccacacaactacgcacgacgtccggtggacgggggccntttacatcatctcagagacgattaccgaaacacagtagaatctaggactaaagtgtacagcctgacgcgccgaggaccaccgggcctctacttcgtgttacgacggaaaattcccgttcgttacggtttcggggcccgtccgggccgtaccgttacggtcgggggttcccgaacgggg

SEQ ID NO: 356325 - DNA, 581 bp, Homo sapiens
  misc_feature: GZ8MTXP01CRB0L.22.36.D03.1.454.CMB.2.raw
  modified_base (216)..(216): a, c, t, g, unknown or other
  misc_feature (216)..(216): n is a, c, g, or t
  modified_base (233)..(233): a, c, t, g, unknown or other
  misc_feature (233)..(233): n is a, c, g, or t
  modified_base (261)..(261): a, c, t, g, unknown or other
  misc_feature (261)..(261): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
  modified_base (379)..(379): a, c, t, g, unknown or other
  misc_feature (379)..(379): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagcattccngcacgtgggaaccaacngtgactagttgggtctttgactctgtcncctggtaccaacaacaccagccaaacccccatcatcattangtntcactcgtcgcctnaggactctctccactcgtctctcaagctccaaagtctggaccaacaccggcctcccaacntctcgtggctccgagtttgacggtacgagtctaacttattactggtactaacgtttaccttaaaagttcggccgtcctacgttcgttcgttcgggtttccggcggtacggtaacgtaaccggaaggttcgacccgttccgtcggttccgttcgaccccgaaggtcctcccgccccgtcggttccctaaccgttccgttcccg

SEQ ID NO: 356326 - DNA, 548 bp, Homo sapiens
  misc_feature: GZ8MTXP01DDY73.22.36.D03.1.454.CMB.2.raw
  modified_base (300)..(300): a, c, t, g, unknown or other
  misc_feature (300)..(300): n is a, c, g, or t
  modified_base (399)..(399): a, c, t, g, unknown or other
  misc_feature (399)..(399): n is a, c, g, or t
  modified_base (491)..(491): a, c, t, g, unknown or other
  misc_feature (491)..(491): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttggccnccaggctccgaggggaggggttgcgaggtgggtcgtcgggggattgggaagtgagtgggtgccacacaacctacgcagacgtccggtggacgggggccncttcatcatctccagacgacgatacgaaaacacagacgaatctaggacaaatgtaacagcctcagcgccgagacgacggcgtctacttctgngacgaagaccttcttagttttcggccgtcggccgacttaccgtcggggccgaacggg

SEQ ID NO: 356327 - DNA, 564 bp, Homo sapiens
  misc_feature: GZ8MTXP01ARP1H.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccggggggtccctgacactctcctgtgcagcctctggattcacagtcagcagcaatgccatgagttgggtccgccaggctccgaggggaagggggttgcgaggtgggtcgtcgggggattggaagtgacgtggtgccacacaactacgcagactccgtgaggggccgcttcatcatctccagagacgacttaccgaaaacacagtagatctaggactaaatgtacagcctcagcgccgacggacgacggccgtctaacttctcgttgacgaaagacccgttcttacgtttttgggcccggtcggccggacgttaccggtcggggccgtaaccgggg

SEQ ID NO: 356328 - DNA, 567 bp, Homo sapiens
  misc_feature: GZ8MTXP01D6CCC.22.36.D03.1.454.CMB.2.raw
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
  modified_base (393)..(393): a, c, t, g, unknown or other
  misc_feature (393)..(393): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatgccatgagttggccncaggctccgagggagggttncgaggtgggtctgggggattggaagtgactgggtgccacacaactacgcagacctccgggtggacgggggcccncttcactcatctccagagaacgacttaccgaaacacagtagaatctaggactaaatagtacacgcctcacgcgccgaggacgccgccgtaactacttctcgttgacgaacgttaccgttcgttacgttttcgggacccgtcggcccgtacgttacggtcggggccgtaaccggg

SEQ ID NO: 356329 - DNA, 557 bp, Homo sapiens
  misc_feature: GZ8MTXP01CEMXD.22.36.D03.1.454.CMB.2.raw
  modified_base (217)..(217): a, c, t, g, unknown or other
  misc_feature (217)..(217): n is a, c, g, or t
  modified_base (250)..(250): a, c, t, g, unknown or other
  misc_feature (250)..(250): n is a, c, g, or t
  modified_base (426)..(426): a, c, t, g, unknown or other
  misc_feature (426)..(426): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgagggaaggggttgcagtgggtctcggggattggaagtgatggtgccacacactacgcagactccgtgagggccncttcatcatctccagagacgattaccgaaaacncagtgaatctgacaaatgtacagcctcagcgccgaggacacggccgtctacttctgtgacgaaagacctcttagtttttcgggccgcggccgaccgtacgtggggccgagggccaacccgtggtcaccgtctcttcacgcctccaccacgggcccatccggtcctccccgtggccncccgtgcctccgaggacgccacccgtccgggacgacgccacgacgccggcccgtgggcctgccctggtccaaggtaacctacttccacgcgtagtcgttcgttggacgcgggcgtggcgaggctcgaagtg

SEQ ID NO: 356330 - DNA, 542 bp, Homo sapiens
  misc_feature: GZ8MTXP01C4LJ0.22.36.D03.1.454.CMB.2.raw
  modified_base (534)..(534): a, c, t, g, unknown or other
  misc_feature (534)..(534): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctctggtaccaacaacacccacggcaaaccccccaatcatcatttatggtgtcactcgcggccctcaggagtctcctcatcgcttctcaggctccaagtctggcaacacggccctaccctaacatctctgggctcgtagtttgaggtacgagtctacttattactgtctaagtttccttaaagttacggctcctacttctcggttggtttccggcggtaaggcacggtaagttcgtaccgtcttcgggttcacgcccagctcgccccttcggtccncgttcccg

SEQ ID NO: 356331 - DNA, 581 bp, Homo sapiens
  misc_feature: GZ8MTXP01EH99P.22.36.D03.1.454.CMB.2.raw
  modified_base (218)..(218): a, c, t, g, unknown or other
  misc_feature (218)..(218): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
  modified_base (341)..(341): a, c, t, g, unknown or other
  misc_feature (341)..(341): n is a, c, g, or t
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaaccaacagtgactattggtctttgactctgtctctgtaccaacaacacccagaccaaacccccatcatcatttangtntcactcgtcggcctnaggactctctcatcgtcttcncagctcaagtctgaccaacncgccctaccctaacatctntcgggcttccgtagtttcgacgacgtatcttacttattactgtcttacgtttacctttaaagttacggcctacctacgttcgtcggtttgggtttcgggccgggtaagccgttaccggtaaagttccggtacccgttccgttccgggttcacggtccccgaaggtccgtcccgccccgttcggtcccttaaccgttccccg

SEQ ID NO: 356332 - DNA, 577 bp, Homo sapiens
  misc_feature: GZ8MTXP01CI0QH.22.36.D03.1.454.CMB.2.raw
  modified_base (298)..(298): a, c, t, g, unknown or other
  misc_feature (298)..(298): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggagcttggtacaggccggggggtccctgacactctcctgtgcagcctctggattcacagtcagcagcaatgccatgagttggccnccaggctccgagggggaaggggttgcgagggtggtcgtcgggggattgggaagtgatgggtgccacaccaactaccgcaaggacctccggtggacgggggccctcttcactcatctcagacgacgtactaccgaaacacagtagaatctaggacaaatgacagcctcacgcgccgacggacgacggcccgtctacttctgttcgacgaacgttaccgttcttacggtttttcgggcccggtccggcccggtacgttaccggtcggggcccggaaccggg

SEQ ID NO: 356333 - DNA, 514 bp, Homo sapiens
  misc_feature: GZ8MTXP01BMTA1.22.36.D03.1.454.CMB.2.raw
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
  modified_base (488)..(488): a, c, t, g, unknown or other
  misc_feature (488)..(488): n is a, c, g, or t
  modified_base (508)..(508): a, c, t, g, unknown or other
  misc_feature (508)..(508): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggaccaaaccccccatcatcatttatgtgtcactcgtcggcctcaggagtctctcatcgcttcncaggctccaagtctgcaacncggcctccctacatctctggctccagtttgagacgagtctacttattactgtctacgtttcctttaaattcgcgtcacttcgtcgtggtttcgcggaagcgacgagttgaccgtccttggttcncgccagctcgccccttgtcncgtccg

SEQ ID NO: 356334 - DNA, 543 bp, Homo sapiens
  misc_feature: GZ8MTXP01CN03V.22.36.D03.1.454.CMB.2.raw
  modified_base (299)..(299): a, c, t, g, unknown or other
  misc_feature (299)..(299): n is a, c, g, or t
  modified_base (358)..(358): a, c, t, g, unknown or other
  misc_feature (358)..(358): n is a, c, g, or t
  modified_base (388)..(388): a, c, t, g, unknown or other
  misc_feature (388)..(388): n is a, c, g, or t
  modified_base (483)..(483): a, c, t, g, unknown or other
  misc_feature (483)..(483): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctcctgtgcagcctctggattcacagtcagcagcaatgccatgagttggtccncaggctcgaggggagggttgcgaggtgggtctcgggggattgggaagtgatggtgccancaactacgcagacctccgtgacgggggccncttcatcatctcagacgacgactaccgaaacacacgtagaatctggactaaatgtacagcctcgagccgcgacggacgacggcgtctacttctgngacgaacgaccgttcgttacgttttgggccgtcggccgtacttaccgtgggccgaacggg

SEQ ID NO: 356335 - DNA, 623 bp, Homo sapiens
  misc_feature: GZ8MTXP01BTWB5.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattggtctttgactctgtctctgtaccaacaacaccacgaccaacccccaactcatctatttatggtgtcactcgtccggccctcgaggagtctcctcatcgcttctcaggctcaagtctggcaacacgccctccctaaccactctcgtcgggcttaccgagtttcgacggtacgtagttactaactttactttaactcgtacgttacgtttacctttaaagttacggccgtccgtaaccttcgttcgggtttcgggttttccgggcgggtaacgggtccgttaccggtaaacggtttcccggttccgtcggggttaccacggccccgtaacggggtccctcccgggtcccccttcgggttccctaaccgttccgtttccccgg

SEQ ID NO: 356336 - DNA, 547 bp, Homo sapiens
  misc_feature: GZ8MTXP01DO9X0.22.36.D03.1.454.CMB.2.raw
  modified_base (306)..(306): a, c, t, g, unknown or other
  misc_feature (306)..(306): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaggtgtcaagtgtgcggtgaaggtattggagtcgtgggggagcttggtacgaggccggggggtccctgacactctcctgtgcagcctctggattcacagtcagcagcaatgccatgagttgggccncaggctccgaggggagggttgcgaggtgggtctcggggattgggaagtgatggtacgccaacacactaacacagacctccggtggacgggccgtcttcgatcatctccagagacgactaccgaaacacaggtagaatctgacaaatgtacaacgcctcacgccgccgaaggacaccggccgttctacgttcttgttcgacgtaacgtacctcgttagttttcgggccgtcggccgtaaccg

SEQ ID NO: 356337 - DNA, 634 bp, Homo sapiens
  misc_feature: GZ8MTXP01ERT42.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtctttgactctgtctctgtaccaacaacacccacgaccaaacccccactcatctatttatgtgtcactcgtcggcctcagagtctctcatcgtcttctacacgtctaccaagtctcggaccaaaccgaccggtacccctacccctaaacctactccgtcgtcgggtccttacccgtaggttttacggaacgggtacgtacgttacttaactttattaccgttagtacttaacgtttacctttaaaagtcggtctcctacgttcgtcggttggtttcgggcggtaaggtaccgaccggtaacgttcgtaacccgttccgttaccgggttccacggaaccccgtaacggcccgttcccggcccccgttcggtaacccttcccgtttccccg

SEQ ID NO: 356338 - DNA, 557 bp, Homo sapiens
  misc_feature: GZ8MTXP01DJY32.22.36.D03.1.454.CMB.2.raw
  modified_base (217)..(217): a, c, t, g, unknown or other
  misc_feature (217)..(217): n is a, c, g, or t
  modified_base (249)..(249): a, c, t, g, unknown or other
  misc_feature (249)..(249): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccnttcatcatctccagagacgattaccgaaaacncagtgaatctgcaaatgtacagcctcagcgccgaggacacggccgtctactctgtgcgaaagacctctattttgggccgcggccgacctacgtggggccagggcaaccctggtcaccgtctcttcagcctccaccaacgggcccatccggtcttcccccgtggccgcccctgcctccgacggacgccaccctccgggacgacgccacgacgccggccctggggcctgcccgtggtccaacgggaacctacgttcccgaccgcgtaagtcgttcgttggacggcgggctgggcaagggcgcgaagtaag

SEQ ID NO: 356339 - DNA, 553 bp, Homo sapiens
  misc_feature: GZ8MTXP01CO2MT.22.36.D03.1.454.CMB.2.raw
  modified_base (405)..(405): a, c, t, g, unknown or other
  misc_feature (405)..(405): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (460)..(460): a, c, t, g, unknown or other
  misc_feature (460)..(460): n is a, c, g, or t
  modified_base (463)..(463): a, c, t, g, unknown or other
  misc_feature (463)..(463): n is a, c, g, or t
  modified_base (492)..(492): a, c, t, g, unknown or other
  misc_feature (492)..(492): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccggggggtccctgacactctcctgtgcagcctctggattcacagtcagcagcaatgccatgagttcgggtccgccaggcgtccgaagggggaagggggttgcgagggtgggtctcgggggatttgggaagtgacgtgggtagccacacaactacgcagactccgtgaggggccncttcatcatctccagagacgacttacgaaacacagtanatnagactaatgacacnccncgacgcgcgagacgacgcgtctcttctgngacgaacgttaccgttcgttacgtttcgggccgtcggccgtacgttacgtcgggcgaacgg

SEQ ID NO: 356340 - DNA, 695 bp, Homo sapiens
  misc_feature: GZ8MTXP01A4IWB.22.36.D03.1.454.CMB.2.raw
  modified_base (171)..(171): a, c, t, g, unknown or other
  misc_feature (171)..(171): n is a, c, g, or t
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccngcctcgcctccgtgtctggatcatctggacagtcgatcagctactttccngcacgtcgggaaccaacgngtagactagttggttctttgacttctcgtcctccgtacgtaaccaacaaccacccgacgaaccccaaaccccccatcactctattagtggtctcactcggtccgcctcgagtctctcctctactcgtcttctacgaacgtcctaccgacgtcgtacgacctaaccgaccgtcccctaccctaacctctcgtcggtcggtccttacgtacggtttacggacggtacgtacgttaccttaactttacgttacgtcgtaccgtttaaccgttttaaccgtttaaaacgtaccggtccctaccgttaccgttccgttcggggtttcgggtttaccgggcgggtaacgggtccgttaacccgggtaacgttccggtacccgttaccggttccggttccgttaccggaacccggtacggtcccgttaccccgtccccgttacggtcccgttcctttccccg

SEQ ID NO: 356341 - DNA, 542 bp, Homo sapiens
  misc_feature: GZ8MTXP01EFO7I.22.36.D03.1.454.CMB.2.raw
  modified_base (122)..(122): a, c, t, g, unknown or other
  misc_feature (122)..(122): n is a, c, g, or t
  modified_base (506)..(506): a, c, t, g, unknown or other
  misc_feature (506)..(506): n is a, c, g, or t
  modified_base (518)..(518): a, c, t, g, unknown or other
  misc_feature (518)..(518): n is a, c, g, or t
  modified_base (534)..(534): a, c, t, g, unknown or other
  misc_feature (534)..(534): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcnccttcctcactcagggcacagggtcctgggcccagtctgccctgacccagcctgcctccgtgtctgatcatctggacagtcgatcagcatttcctgcactgggaccaacagtgactattgggtctttgactctgtctctgtaccaacaacacccagaccaaaccccccactcatcatttatggtgtcactcgtccggccctcaggagtctcctcatcgcttctcagctccaagtctcggacaacgcgccctacccctaacatcctcgtgggcctacctagtttgaggtacgagtctacttattactgtactagtttacctttaaagtcgctccgacttctcgttggtttcggcgtaaggcgacgagttcgaccgtccgcgttcncgcccaggtccnccgccccgttggtccncgttcccg

SEQ ID NO: 356342 - DNA, 544 bp, Homo sapiens
  misc_feature: GZ8MTXP01CS7NI.22.36.D03.1.454.CMB.2.raw
  modified_base (399)..(399): a, c, t, g, unknown or other
  misc_feature (399)..(399): n is a, c, g, or t
  modified_base (434)..(434): a, c, t, g, unknown or other
  misc_feature (434)..(434): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccgggggggtccctgacactctcctgtgcagcctctggattcacagtcagcagcaatgccatgagttggccgcaggctccgagggggaaggggttgcgaggtgggtctgggggattgggaagtgactgggtgccacgacaacctacgcagaccgtccgtgacgggggccnttcatcatctccagagacgattaccgaaacacagngaatcaggacaaatgtacagcctcacgcgccgagacgacgccgtctacttctgttgacgaagaccttcttagttttcgggccgtcggccgcttacgtcgggccgaacggg

SEQ ID NO: 356343 - DNA, 615 bp, Homo sapiens
  misc_feature: GZ8MTXP01DJROD.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcgttgggtacgacggccgggggggtccctgacactctcctgtgcagcctctggattcacagtcagcagcaatgccatgagtggccgccaggctccgaggggtaagggttgcgaggtggtcgtcggggattgggaaggtgagtggtacgccaacacacgtaccgcaggacctccggtggacggggccgtcttcatcatcctccaagtacgaaccaacgttaacccgaaaacaccgtaaggggtacgaaaagttcctaagaacctaaaagtcggtaacaacgtccctagaacgccgccgtaacgggaaccaccggggtccttccgttacttccgttgttcggaacgtaaacgtcccttcgtttaacgttttcgggacccgtcggcccgtaaccg

SEQ ID NO: 356344 - DNA, 661 bp, Homo sapiens
  misc_feature: GZ8MTXP01D6ACS.22.36.D03.1.454.CMB.2.raw
  modified_base (277)..(277): a, c, t, g, unknown or other
  misc_feature (277)..(277): n is a, c, g, or t
  modified_base (470)..(470): a, c, t, g, unknown or other
  misc_feature (470)..(470): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggagcttgggtacgaggccgggggggtcctggacactctcctgtcgcagcctctggattcacngtcagcagcaatgccatgaggtttcgggcccgccgaggctcccggaagggggtaagggggttgcgtagggttgggtcgtcgggggtatttgggaacgtggagttgggcgaccacacaaccgttacgcacgaccgtccggtggacgggggccctcttcactcatccgtaccagacgaacgacttaccgaaaacncaagtgaaatctaggaactaaagtcgtaacgagccctacgacggacccgccggaacggaccgacccgggtcccgttaacttaaccttccgtaggttaccgaaccggtaaacgttaccgttcgtttacgggttttccgggcccggtccgggtcccgaaccggttaccgggtcgggggcccgtaacccggggg

SEQ ID NO: 356345 - DNA, 539 bp, Homo sapiens
  misc_feature: GZ8MTXP01EARW0.22.36.D03.1.454.CMB.2.raw
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (536)..(536): a, c, t, g, unknown or other
  misc_feature (536)..(536): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccgaggggaaggggttgcaggtgggtctcggggattggaagtgatggtgccacacactacgcagactccgtgaggggccncttcatcatctccagagacgattaccgaaaacncagtgaatctgcaaatgtacagcctcagcgccgaggacacggccgtctacttctgtgcgaaagacctcttagtttttcgggccgtcggccgtacctacgtggggccagggcaacccgtggtcaccgtctcttcacgcctcaccaacgggcccagtccggtccttcccccgtggccgccctgcctccaggacgcaccctccgggagcgcacgagccggccctgggcctgcctggtcaaggctacttccacgcgtatgttcgttgacgcgggctggcaggcgcngtg

SEQ ID NO: 356346 - DNA, 608 bp, Homo sapiens
  misc_feature: GZ8MTXP01C7PZX.22.36.D03.1.454.CMB.2.raw
  modified_base (234)..(234): a, c, t, g, unknown or other
  misc_feature (234)..(234): n is a, c, g, or t
  modified_base (312)..(312): a, c, t, g, unknown or other
  misc_feature (312)..(312): n is a, c, g, or t
  modified_base (346)..(346): a, c, t, g, unknown or other
  misc_feature (346)..(346): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaaccaanagtgactagttgggtctttgactctgtctctggtaccaaacaacacccaggaccaaaccccccactcatcattatgtntcactcgtcgcctcaggatctctcatcgcttccncgacgtctacagtctcgacaacgacgtccctaccctaacctactctcgtcggtctacgtagttacgacggtacgtacgttacttacttaacttacgtcgtacgttaacgtttacgtttaaagttacggtccgtacctacgttcgttcggtttcgggttccgggacgggtaacggtaccgaaccggtaacgttccggtacccgttccgttcggttccgacgcccgaacggtccgtcccgccccgttccgtccgttccgttccg

SEQ ID NO: 356347 - DNA, 541 bp, Homo sapiens
  misc_feature: GZ8MTXP01C1XW1.22.36.D03.1.454.CMB.2.raw
  modified_base (215)..(215): a, c, t, g, unknown or other
  misc_feature (215)..(215): n is a, c, g, or t
  modified_base (246)..(246): a, c, t, g, unknown or other
  misc_feature (246)..(246): n is a, c, g, or t
  modified_base (515)..(515): a, c, t, g, unknown or other
  misc_feature (515)..(515): n is a, c, g, or t
  modified_base (534)..(534): a, c, t, g, unknown or other
  misc_feature (534)..(534): n is a, c, g, or t
  modified_base (540)..(540): a, c, t, g, unknown or other
  misc_feature (540)..(540): n is a, c, g, or t
tcagacatacgcgtcacgaccggtgctcgatttagctgcgtcacgatctctcttgggtttggggggtccctgacactctcctgtgcagcctctggattcacagtcagcagcaatgccatgagttgggtccgccaggctccagggaagggttgcagtgggtctcggggattggaagtgatgggtgccacacactacgcagactccgtgaggggccncttcatcatctccagagacgattccgaaaancagtgaatctgacaaatgtacagcctcagcgcgaggacacggccgtctactctgtgcgaaagacctctagttttcggccgcggccgaccgtacgtggggccagggcaaccctggtcaccgtctcttcagccctccaccaacgggcccagtccggtcctcccccgtgcccgtcccctgcctccgaagcaccacctccgggaagacgccacgacgccggccctgggcctacgcctggacaaggcctacttcgacgccgtatcgttcgttgnggcggctgggccaggccgnttaagng

SEQ ID NO: 356348 - DNA, 518 bp, Homo sapiens
  misc_feature: GZ8MTXP01BGYG8.22.36.D03.1.454.CMB.2.raw
  modified_base (353)..(353): a, c, t, g, unknown or other
  misc_feature (353)..(353): n is a, c, g, or t
  modified_base (427)..(427): a, c, t, g, unknown or other
  misc_feature (427)..(427): n is a, c, g, or t
  modified_base (511)..(511): a, c, t, g, unknown or other
  misc_feature (511)..(511): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctggtaccaacaacacccagccaaacccccatcatcattatgtgtcactcgtcgcctcagagtctctcatcgctctcagctcaagtctgcaacncgcctcctaacatctctggctccgtagtttgagacgagtctacttattactgtctagttacctttaaatcggcncctactctcgtggtttcggcggtaagcgaccgaagttcgaccgtcgttcggttcacgtccaagggtcctcgccccgttcggtcncgttccg

SEQ ID NO: 356349 - DNA, 589 bp, Homo sapiens
  misc_feature: GZ8MTXP01CIZY1.22.36.D03.1.454.CMB.2.raw
  modified_base (300)..(300): a, c, t, g, unknown or other
  misc_feature (300)..(300): n is a, c, g, or t
  modified_base (319)..(319): a, c, t, g, unknown or other
  misc_feature (319)..(319): n is a, c, g, or t
  modified_base (393)..(393): a, c, t, g, unknown or other
  misc_feature (393)..(393): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacagggccggggggtcctgacactctcctgtgcagcctctggattcacagtcagcagcaatgccatgagttggccncaggctcgagggagggttncgaggtggtcgtgggggattgggaagtgacgtggtgccacacaacgtacgcagactccggtaggacggggcccntcatcatctcagacgacgacttaccgaaacacagtagaatctaggacaaatacgtacaacgccctacgacggaccgaccgaacggaccgaaccgggtcccgtaacttacgttcgtcgttacgaacgaaacgttaccgttcgttacgttttcgggacccgtccggccgtaccgttacggtcggggcccgaaccgggg

SEQ ID NO: 356350 - DNA, 565 bp, Homo sapiens
  misc_feature: GZ8MTXP01BABDS.22.36.D03.1.454.CMB.2.raw
  modified_base (349)..(349): a, c, t, g, unknown or other
  misc_feature (349)..(349): n is a, c, g, or t
  modified_base (370)..(370): a, c, t, g, unknown or other
  misc_feature (370)..(370): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctggtaccaacaacaccccaggaccaaacccccccaactcatctatttatggtgtcactcgtcggccctcaggagtctctcatcgcttcncaggctccaagtctggcaacncgccctccctaaccatctcgtgggctccgtagtttgaggacgagtctacttattacgtgctacgtttacctttaaagttacggccgtcctacttcttcggttcgggtttccggcggtaacggcaccggtagttcgacccgttccgttcggttcacgtcccgaggtcctcgcccccgttggtccttaacgttcccg

SEQ ID NO: 356351 - DNA, 622 bp, Homo sapiens
  misc_feature: GZ8MTXP01ALG42.22.36.D03.1.454.CMB.2.raw
  modified_base (409)..(409): a, c, t, g, unknown or other
  misc_feature (409)..(409): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggcttggtacgagggccggggggtccctgacactctcctgtgcagcctctggattcacagtcagcagcaatgccatgagttggccgtgaggctccggaggggtaaggggttgcgtaggtgggtcgtcgggggattgggaagtgacgtggtgccacgacaactacgcacgaccgtccggtgggacggggccncttcactcactctaccagacgacgtactaccgaaaacacgagtagaatctaggactaaatcgtaacacgccgtcgacggaccgacccgaacggaccgaccgggtcccgttcgttaaccgttcgtcgttacgaaccgtaaacgttacccgttcgtttacgttttcgggcccgtccgggtacccgtacgttaccggtcggggcccgtaaccgggg

SEQ ID NO: 356352 - DNA, 639 bp, Homo sapiens
  misc_feature: GZ8MTXP01C944S.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggcttaattttaaaaggtgtcaagtgtgcggtgaaggtattggagtcgtgggggaggtcgttggacgacggccgggggggtccctgacactctcctgtcgcagcctcgtggattcacagtcagcagacaatgcccagtggaggtttcgggcccgccgaaggccgtaccggagggggtaagggggtgcgtaggtggggtcgtcgggggtattgggaagtgagtggtacgcccaacgacacgtacgacgacgaccgtcggagggacgggccgtcgttcatcactctacagacgacgaacgttaccgaaaacacgaaggtaacgtaataccgtagtaacaaatcgtacaacgtcctacacggccgaccgaaggaccgaccggtcgttaccttacgttcttacggttcgaacggtaaaccgtaccgttcgtttacggttttccggggcccggtccgggttcccggtaacccgg

SEQ ID NO: 356353 - DNA, 617 bp, Homo sapiens
  misc_feature: GZ8MTXP01E1K8P.22.36.D03.1.454.CMB.2.raw
  modified_base (319)..(319): a, c, t, g, unknown or other
  misc_feature (319)..(319): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaaccaacagtgacattgggtctttgactctgtctctgtaccaacaacaccacgaccaaacccccatcatcattatgtgtcactcgtcggcctnaggacgtctcctcatcgcttcctacacggtctaccgaaagtctacggaccaaaccgaccggtccctacccctaaaccacttccgtcgtcgggccttacccgtaggttttcgacgggtaacgtacgttaccttaactttacttacggtcgtacgttaacgtttaccctttaaaagttacggccgtaccctaccgttcgttcggttcgggttttccgggcgggtaacgtcgaccggtaagttcgtacccgtcgttcggttcacgcccgaacgtcgtccgccccttcggtcaaccgttccg

SEQ ID NO: 356354 - DNA, 639 bp, Homo sapiens
  misc_feature: GZ8MTXP01EW85B.22.36.D03.1.454.CMB.2.raw
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (390)..(390): a, c, t, g, unknown or other
  misc_feature (390)..(390): n is a, c, g, or t
  modified_base (441)..(441): a, c, t, g, unknown or other
  misc_feature (441)..(441): n is a, c, g, or t
  modified_base (504)..(504): a, c, t, g, unknown or other
  misc_feature (504)..(504): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctaggtaccaacaacacccagccaaaccccccatcatcattatggtntcactcgtccggccctnaggacgtctcctcatcgcttctcaggcctacaagtctcggacaactacggccctaccctaaaccntctcgtcgggctacccgagtttcgacgggacgtacttcttacttattacgngtactaacgtttacctttaaagttacgggcctacctacgttcgttcgggttgggtttccgggngggtaacggtccttaaaccgggtaaacgttccggtaaccccgggttccttaccggggttcccaaccgggtaacccccgaaggggtcccttcccgggcccccccgttacggggtccccgttaacccgtttccccgg

SEQ ID NO: 356355 - DNA, 573 bp, Homo sapiens
  misc_feature: GZ8MTXP01DIQTL.22.36.D03.1.454.CMB.2.raw
  modified_base (408)..(408): a, c, t, g, unknown or other
  misc_feature (408)..(408): n is a, c, g, or t
  modified_base (507)..(507): a, c, t, g, unknown or other
  misc_feature (507)..(507): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccgggggggtccctgacactctcctgtgcagcctctggattcacagtcagcagcaatgccatgagttggccgccagctccgaggggaaggggttgcgaggtgggtcgtcgggggattgggaagtgacgtgggtcgccaacgacaacctacgcaaggaccgtcccggtggacgggggccncgttcatcatctcagagacgataccgaaaacacagtagaatctaggactaaatagtacagcctcagccgcgacggaccgaccggccgtctacttctcgngacgaacgttccgttcttacggttttcgggaccggtcggccgacgttacggtcgggccgaaccggg

SEQ ID NO: 356356 - DNA, 552 bp, Homo sapiens
  misc_feature: GZ8MTXP01DOY0J.22.36.D03.1.454.CMB.2.raw
  modified_base (306)..(306): a, c, t, g, unknown or other
  misc_feature (306)..(306): n is a, c, g, or t
  modified_base (397)..(397): a, c, t, g, unknown or other
  misc_feature (397)..(397): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccgggggggtccctgacactctcctgtgcagcctctggattcacagtcagcagcaatgccatgagttggccnccaggctcgaggggagggttgcgagtgggctcgggggattgggaagtgagtggtacgccaacacactacggcagactccggtgacggggcncttcatcatctcagagacgataccgaaaacacaggtagaatctagacaaatgtacacgctcagcgccgaagacacggtccgttcgtaacttcttcgttcgacgtaaacgtaccttcgtttaacgttttcgggcccggtccggttcccggtaaccg

SEQ ID NO: 356357 - DNA, 545 bp, Homo sapiens
  misc_feature: GZ8MTXP01DN719.22.36.D03.1.454.CMB.2.raw
  modified_base (216)..(216): a, c, t, g, unknown or other
  misc_feature (216)..(216): n is a, c, g, or t
  modified_base (332)..(332): a, c, t, g, unknown or other
  misc_feature (332)..(332): n is a, c, g, or t
  modified_base (508)..(508): a, c, t, g, unknown or other
  misc_feature (508)..(508): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgaactatttgggtcttttgactctgtctcctggtaccaacaaacacccaggccaaaccccccaactccatcatttatggtgtcactccgtcggcccctnaggagtctctccatcgcttctcaaggctccaagtctaggcaacacggcctccctaaccatctctgggctctagtttgaggacagtctactttatctggctagtttccttaaatagcgcctactcgttcgttggtttcggcggagtcaccgttaaggtcgttaccgtcctcggttcncgcccaaggctcgcccctggttctccgttcgttcccg

SEQ ID NO: 356358 - DNA, 555 bp, Homo sapiens
  misc_feature: GZ8MTXP01CA1XK.22.36.D03.1.454.CMB.2.raw
  modified_base (233)..(233): a, c, t, g, unknown or other
  misc_feature (233)..(233): n is a, c, g, or t
  modified_base (348)..(348): a, c, t, g, unknown or other
  misc_feature (348)..(348): n is a, c, g, or t
  modified_base (368)..(368): a, c, t, g, unknown or other
  misc_feature (368)..(368): n is a, c, g, or t
  modified_base (382)..(382): a, c, t, g, unknown or other
  misc_feature (382)..(382): n is a, c, g, or t
  modified_base (385)..(385): a, c, t, g, unknown or other
  misc_feature (385)..(385): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgacattgggtctttgactctgtctcctggtaccaacaacacccaggccaaaccccccaactcatcatttatggtgtcacgtcgtcggccctcaggactctcctcatcgcttcncagctccaagtctggcaacncggcctccctaacntcnctgggctccgtagtttcgacggacgtacgttctacttacgttactgtctagtttaccttaaattacggcgacctactcgttccggttggtttcggcggtaagcacggaagttcgaccgtccttcgggttcacgtcccagtcctccgccccgttcggtccaaccgttcccg

SEQ ID NO: 356359 - DNA, 681 bp, Homo sapiens
  misc_feature: GZ8MTXP01DUEJR.22.36.D03.1.454.CMB.2.raw
  modified_base (399)..(399): a, c, t, g, unknown or other
  misc_feature (399)..(399): n is a, c, g, or t
tcagacatacgcgtcacgaccggtgctcgatttagctgcgtcacgatctctcttggggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccgggggggtccctgacactctcctgtgcagcctctggacttcacagtcagcagcaatcgccatggagttcgggtccgccgaggctaccggagggggaaggggttgcgtagggtcgggggtaccggggtagttcgggaagtgagtcggtcgaccacacactaacgacncgacgtccggtggacggggccgcttcactctatcctacaggaacgaacgtaacgttaaccgaaaacgaccgaagtacgtaaactacgttacggaactaaacgtacggtaacacgtaccgtaccgacggaccggaccggaacggaccgtacccgggtcccgtaccgttaacctttacgttcgttacggaaaccgtaaacgtaaccgtttaccgtttacggttttcgggaaccccggtcggtaacccgtacgtaccggttcggggaacccgccgggtaaccccg

SEQ ID NO: 356360 - DNA, 538 bp, Homo sapiens
  misc_feature: GZ8MTXP01EG2IO.22.36.D03.1.454.CMB.2.raw
  modified_base (325)..(325): a, c, t, g, unknown or other
  misc_feature (325)..(325): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctggtaccaacaacacccaggaccaaaccccccaactcatcatttatgtgtcactcgtcggccctnaggagtctcctcatcgcttctacacggctccaaagtctggccaacgaccggccctaccctaaccatctctgggcctcctagtttgaggtacgagtctacttattacgtgctagtttacttaaatgcgctactctcgttggtttcgcggaagcacgtagttcgaccgtcttcggttcacgcccaaggcctcgccccttcggtccttcgttcccg

SEQ ID NO: 356361 - DNA, 622 bp, Homo sapiens
  misc_feature: GZ8MTXP01CJ91B.22.36.D03.1.454.CMB.2.raw
  modified_base (398)..(398): a, c, t, g, unknown or other
  misc_feature (398)..(398): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccgggggggtccctgacactctcctgtgcagcctctggattcacagtcagcagcaatgccatgagttgggtccgccaggctccgagggggaaggggttgcaggtggggtcgtcgggggattgggaagtgatggtgccacacaactacgcagactccggtgacggggccnctcatcatctccagagaacgacttaccgaaaacacgagtagaactcgtagggactaaagtacgtaacgacgtaccctcgacggacccggaccggaacgggaccgaacccgggcccgttccttaaccgtttccgtcgttcgaaccggtaacgttacccgttcgtttacggtttttcggggcccggtccgggcccggtacgttccggtcggggcccgtaaccgggg

SEQ ID NO: 356362 - DNA, 586 bp, Homo sapiens
  misc_feature: GZ8MTXP01ASYOA.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctggtaccaacaacacccagaccaaaccccccactcatcattatgtgtcactcgtcggccctcaggatctcctcatcgctctcagctcaagtctgcaacacgcctccctaacatctcgtggctacgagttcgagacgtagtactacttattacgtgtctacgtttaccctttaaagtacggtccacctacgttccgttcggttcgggttttcggcgggtaaggaccgaaccggtaaggttccgtaacccggttccttaccgggttccgacggtccccgaaacgggtcccttccggtcccccgttccgggtccttaacccgtttcccg

SEQ ID NO: 356363 - DNA, 509 bp, Homo sapiens
  misc_feature: GZ8MTXP01AXPXY.22.36.D03.1.454.CMB.2.raw
  modified_base (307)..(307): a, c, t, g, unknown or other
  misc_feature (307)..(307): n is a, c, g, or t
  modified_base (353)..(353): a, c, t, g, unknown or other
  misc_feature (353)..(353): n is a, c, g, or t
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
  modified_base (427)..(427): a, c, t, g, unknown or other
  misc_feature (427)..(427): n is a, c, g, or t
  modified_base (444)..(444): a, c, t, g, unknown or other
  misc_feature (444)..(444): n is a, c, g, or t
  modified_base (467)..(467): a, c, t, g, unknown or other
  misc_feature (467)..(467): n is a, c, g, or t
  modified_base (502)..(502): a, c, t, g, unknown or other
  misc_feature (502)..(502): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctctggtaccaacaacacccaggccaaaccccccaatcatcattatgtntcactcgtcggccctcaggatctctcatcgcttctcagctcagtcngcacncgcctcctacntctcgtggctcagtttgacggacgtagtctacttatactgactattaccttaaatgcnctactctcgtggttcgnggtaagcacgtagcgtaccgtcncggttcacgcccaggtcctcgccccgttgtaaccncgttccg

SEQ ID NO: 356364 - DNA, 515 bp, Homo sapiens
  misc_feature: GZ8MTXP01AYUF5.22.36.D03.1.454.CMB.2.raw
  modified_base (214)..(214): a, c, t, g, unknown or other
  misc_feature (214)..(214): n is a, c, g, or t
  modified_base (246)..(246): a, c, t, g, unknown or other
  misc_feature (246)..(246): n is a, c, g, or t
  modified_base (497)..(497): a, c, t, g, unknown or other
  misc_feature (497)..(497): n is a, c, g, or t
  modified_base (504)..(504): a, c, t, g, unknown or other
  misc_feature (504)..(504): n is a, c, g, or t
  modified_base (511)..(512): a, c, t, g, unknown or other
  misc_feature (511)..(512): n is a, c, g, or t
  modified_base (514)..(514): a, c, t, g, unknown or other
  misc_feature (514)..(514): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaagggttgcagtgggtctcggggattggaagtgatggtgccacacactacgcagactccgtgagggccncttcatcatctccagagacgattccgaaaacncagtgaatctgcaaatgtacagcctcagcgccgaggacacggccgtctacttctgtgcgaaagcctctatttttgggccgcggccgacctactggggccagggcaaccctgggtcaccgtctcttcagcctcaccaacgggcccatcggtcttccccctggccgccctgcctccaggacgcacctccggagacgcacagccggccctggggctcgcctggtcaaggctacttccacgcgtatgttcgttgngcggcgngcaggcnngng

SEQ ID NO: 356365 - DNA, 629 bp, Homo sapiens
  misc_feature: GZ8MTXP01D4Z45.22.36.D03.1.454.CMB.2.raw
  modified_base (306)..(306): a, c, t, g, unknown or other
  misc_feature (306)..(306): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttatttaaaaggtgtcaagtgtgcggtgaaggtattggagtcgtgggggagcgttggtacaggccggggggtccctgacactctcctgtgcagcctcgtggattcacagtcagcagcaatgccatgagtggccnccgaggctcgaggggtaagggttgcgaggtgggtcgtcggggtattgggaaagtgagtggtacgaccctaacacaccgtacgacgtaagaccgtcccggtggacggggccctcgttacacttaccacttacctaccgaagaacgaaccgaacttaaccggaaaactaccgaaggtagtaaattccagaactaaagtgtaaccacgccctcgacgcccgccggaacggacccgaccgggtcccttactaacgttccgttaggttcgttaaccggaaactcccgttaacgtttacggtttcgggacccggtccggcccggtaacg

SEQ ID NO: 356366 - DNA, 639 bp, Homo sapiens
  misc_feature: GZ8MTXP01B19NU.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctcctgtgcagcctctggattcacagtcagcagcaatgccatgagttggccgcaggctccgaggggaaggggttgcgagggtggtcgtcgggggattgggaagtggatgggtgccacacaactacgcacgacgtccggtggacgggggcctcttcatcacgtctccgagacgaacgtacttaaccgaaaactacgagtagtaactctacgggactaaagtcgtaacgacggccctcgacgccgaccggtacggaccgaccgggtccgtaaccgttaaccttcgtcggttacggaccgtaaaacgttacccgtttcgtttaacggtttttccggggacccggtccgggtacccggtacgttacccgggtccggggttaacccggtaacccgggg

SEQ ID NO: 356367 - DNA, 600 bp, Homo sapiens
  misc_feature: GZ8MTXP01D80PZ.22.36.D03.1.454.CMB.2.raw
  modified_base (374)..(374): a, c, t, g, unknown or other
  misc_feature (374)..(374): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccggggggtccctgacactctcctgtgcagcctctggattcacagtcagcagcaatgccatgagttgggtccgcaggctccgaggggaagggttgcgaggttggtcgtcgggggtattggagtgatggtgccacacaactacgnagacctccgtgacggggccgcttacgatcatctcagagacgattaccgaaaacacaagtagaaatctagggactaaagtacgttacacgcctaccgacgaccggaccgacgggaccgaccggcccggtaaccttaaccgttcgtggttcgacgtaaaacgttccgttcgttacgttttcggggcccgtccgggtcccggaccgttacgtcggggccgaacccgggg

SEQ ID NO: 356368 - DNA, 548 bp, Homo sapiens
  misc_feature: GZ8MTXP01BE81X.22.36.D03.1.454.CMB.2.raw
  modified_base (339)..(339): a, c, t, g, unknown or other
  misc_feature (339)..(339): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaaacaacacccaggcaaaccccccaatcatcatttatggtgtcactcgtcggcctcaggatctctcatcnctctcacgctcacgtctgacaacacgcctaccctaaccactctctggctactacgttagtaggacgacgtacttacttaattacgtcgtctacttactttaaacttaacgtcgacctactctcgttcggtttcggtcgggaacggcgacgaacgttcgtaccgtccgttcgttcgacgaaccgacgcgtcgccccgttccgtccgcgtc

SEQ ID NO: 356369 - DNA, 574 bp, Homo sapiens
  misc_feature: GZ8MTXP01C6R73.22.36.D03.1.454.CMB.2.raw
  modified_base (300)..(300): a, c, t, g, unknown or other
  misc_feature (300)..(300): n is a, c, g, or t
  modified_base (474)..(474): a, c, t, g, unknown or other
  misc_feature (474)..(474): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggagcttggtacaggccggggggtcctgacactctcctgtgcagcctctggattcacagtcagcagcaatgccatgagttggccncaggctccgaggggaagggttgcgaggtgggcgtgggggattggaagtgactggtgccacacaaactacgcagacctccggtaggacgggggcctcttcatcactctaccaagacgaacgtaacttaccgaaaacaaccgaagtagaaatcctaggactaaatgtaacacgccncacgccgccgaggaccaccggccgtctacttcgtcgagtacgaacgacgttcgttacgttttcggcccgtcggccgtacgttacgtcgggccgaaccggg

SEQ ID NO: 356370 - DNA, 522 bp, Homo sapiens
  misc_feature: GZ8MTXP01EOXW6.22.36.D03.1.454.CMB.2.raw
  modified_base (303)..(303): a, c, t, g, unknown or other
  misc_feature (303)..(303): n is a, c, g, or t
  modified_base (339)..(339): a, c, t, g, unknown or other
  misc_feature (339)..(339): n is a, c, g, or t
  modified_base (359)..(359): a, c, t, g, unknown or other
  misc_feature (359)..(359): n is a, c, g, or t
  modified_base (515)..(515): a, c, t, g, unknown or other
  misc_feature (515)..(515): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtctttgactctgtctctggtaccaacaacacccacgccaaacccccatcatcatttangtgtcactcgtcgcctcagatctcctcatcgcttcncagctacagtctggacaacncgccctccctacatctctggctccgagttgagacagtcttacttattacgtgtctaagtttacctttaaagtacggctctacttctcgttggtttcggcggaagcacgagttcgaccgtcttcggttcacgcccaggcctccgccccttcggtccncgttccg

SEQ ID NO: 356371 - DNA, 667 bp, Homo sapiens
  misc_feature: GZ8MTXP01BXBD9.22.36.D03.1.454.CMB.2.raw
  modified_base (218)..(218): a, c, t, g, unknown or other
  misc_feature (218)..(218): n is a, c, g, or t
  modified_base (306)..(306): a, c, t, g, unknown or other
  misc_feature (306)..(306): n is a, c, g, or t
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgactagttggtctttgactctgtctctgtaccaacaacacccacgaccaaacccccatcatcatttatgtntcactcgtcgcctnagntctcctcatcgtctctcacggctccaagtctcggacaacgccggtccctaccctaaccacttcctcgtcgggccttacccgtaggttttcggaacggtacgtacgttaccttaactttacttacgttgtaccgttacgtttaacccgtttaaagttcggtaccgtacctaaccgttccgttccgggtttcggggtttttccgggcgggtaacgggtacccgttaaccgggtaaacggttccggtaaacccggttcccgttaccgggttccgaccggtaaccccggtaaaccgggtcccgttacccgggtccccccgttccggggtcccttaacccgtttccccg

SEQ ID NO: 356372 - DNA, 528 bp, Homo sapiens
  misc_feature: GZ8MTXP01D52S0.22.36.D03.1.454.CMB.2.raw
  modified_base (377)..(377): a, c, t, g, unknown or other
  misc_feature (377)..(377): n is a, c, g, or t
  modified_base (445)..(445): a, c, t, g, unknown or other
  misc_feature (445)..(445): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctcctggtaccaacaacacccaggaccaaaccccccaactcatcatttatgtgtcactcgtcggcctcagagtctctcatcgcttctcagctcaagtctgcacacgcctcctacatcnctggctccgagtttgacggtacgtagtcttaacttattacgtgtactagtttacctttaaatacggcncctactctcgtggttttcgcggtaagcacgaagttcgaccgtcttcggttcacgtccaggcctcgccccttcgtcaacgttcc

SEQ ID NO: 356373 - DNA, 544 bp, Homo sapiens
  misc_feature: GZ8MTXP01AZDA2.22.36.D03.1.454.CMB.2.raw
  modified_base (363)..(363): a, c, t, g, unknown or other
  misc_feature (363)..(363): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttgggtccgccaggctccgaggggaaggggttgcagtggggtctcgggggattggaagtgatggtgccanacaactacgcagactccgtgaggggccgcttcatcatctccagagacgattaccgaaacacagtgaatctggcaaatgtacagcctcagcgccgaggacacggccgctacttctgttcgcgaagacccgttcgttacttttcgggccgtcggcccgacgttacgtcggggccgaaccgggg

SEQ ID NO: 356374 - DNA, 531 bp, Homo sapiens
  misc_feature: GZ8MTXP01D71W9.22.36.D03.1.454.CMB.2.raw
  modified_base (305)..(305): a, c, t, g, unknown or other
  misc_feature (305)..(305): n is a, c, g, or t
  modified_base (323)..(323): a, c, t, g, unknown or other
  misc_feature (323)..(323): n is a, c, g, or t
  modified_base (452)..(452): a, c, t, g, unknown or other
  misc_feature (452)..(452): n is a, c, g, or t
tcagacatacgcgtcacgaccggtgctcgatttagctgcgtcacgatctctcttggggagctctgagagaggagcccagccctgggattttcaggtgtttcatttggtgatcaggactgaacagagagaactcaccatggagtttgggctgaagtggctttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttgggccnccaggctcagggagggtncaggtgggtctcgggggattgggaagtgatggtcgccaacacactacgcagactcgtgagggcgcttcatcatctccagagacgattaccgaaaacacaaggtagaatcctagacaaatgtacagcctnagcgccgaaggacacggccgttcgtaacttcttgttgacgaaaggacctcttacgttttcgggccgtcggccggtaacg

SEQ ID NO: 356375 - DNA, 556 bp, Homo sapiens
  misc_feature: GZ8MTXP01EGL5P.22.36.D03.1.454.CMB.2.raw
  modified_base (368)..(368): a, c, t, g, unknown or other
  misc_feature (368)..(368): n is a, c, g, or t
  modified_base (389)..(389): a, c, t, g, unknown or other
  misc_feature (389)..(389): n is a, c, g, or t
tcagacatacgcgtcacgaccggtgctcgatttagctgcgtcacgatctctcttggggagctctgagagaggagcccagccctgggattttcaggttgttttcatttggtgatcaggactgaacagagagaactcaccatggagtttgggctgaagtggcttttgcttgtggcttattttaaaaggtgtcaagtgtgcggtgaaggtattggagtcgtgggggagcttggtacgaggccggggggtcctgacactctcctgtcagcctctggatcacagtcagcagcaatgccatgagttggccgcaggctccgaggggaagggttgcgagtgggtcgtcggggattgggaagtgagtggtgaccacncactacgcacgaccgtccggnggacggggccgcgttcatcactctaccagagacgacttaccgaaaacacagtaggaatctagacaaatgtacagcctcacgcgccgagaacgcggccgtcttacgtcgtgttcgcgaaacgtaacctcttaagttttcgggccggttccggtccgaacgtaaccggg

SEQ ID NO: 356376 - DNA, 579 bp, Homo sapiens
  misc_feature: GZ8MTXP01EF1IH.22.36.D03.1.454.CMB.2.raw
  modified_base (219)..(219): a, c, t, g, unknown or other
  misc_feature (219)..(219): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgagggaaggggttgcaggtgggtctcggggattggaagtgatggtgccacacactacgcagactccgtggagggccncttcatcatctccagagacgattaccgaaaacacagtgaatctgcaaatgtacagcctcagcgccgaggacacggccgtctacttctgtgacgaaagacctcttagtttttcggccgcggccgacctacgtggggccgagggccaaccctggtcaccgtctcctcacgcctccaccaacgggcccagtcgtccttccccgtggccgccctcgctccgacgacgccacccgtccggacgacggcacgacggccggccccgtggggccttcgccgtcggtccgaaacgggaaccttacgttcccgacgttccgttaagtgttcgttcggacggccgggtcgtgggccgagggccggcaagtg

SEQ ID NO: 356377 - DNA, 590 bp, Homo sapiens
  misc_feature: GZ8MTXP01EE2UM.22.36.D03.1.454.CMB.2.raw
  modified_base (274)..(274): a, c, t, g, unknown or other
  misc_feature (274)..(274): n is a, c, g, or t
  modified_base (419)..(419): a, c, t, g, unknown or other
  misc_feature (419)..(419): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcagcctctggattcacngtcagcagcaatgccatggagttgggccgtcaggctccgagggggaacggggtttgcgaggttggggtcgtcgggggtattgggaagtgagtgggtcgcccacgacaaaccgtacgctaggaccttccgggtggacgggggcccncgttcactcatctcagagacgacttaccaaacacagagaaatctgactaaatgtacagcctcgagccgacgaggaccaccggccgtctacgttctgttgacgaaacgttaccgttcgttacgttttcgggaccgtcgggcccgacgttaccggtcgggggccgaaccgggg

SEQ ID NO: 356378 - DNA, 615 bp, Homo sapiens
  misc_feature: GZ8MTXP01CO1S8.22.36.D03.1.454.CMB.2.raw
  modified_base (326)..(326): a, c, t, g, unknown or other
  misc_feature (326)..(326): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
  modified_base (483)..(483): a, c, t, g, unknown or other
  misc_feature (483)..(483): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgagggccggggggtcctgacactctctgtgcagcctctggattcacagtcagcagcaatgccatggagttgggcccgcaggctccgaggggaaggggttncgtaggtggggtcgtgggggattgggaagtggactgggtcnccacacaactacgcaagaccgtccggnggacgggccgcttcactcatctcagacgaacgtactaaccgaaaacacaagtacgaaatccgtaggaactaaagtacgtaacacgtccncgacggacccggccggaacggaccgaaccggtcccgtaaccttacttcgtagttcgaacgtaaacgttaccgttcgttacggttttaacgggcccgtccggcccgtacgttacggtcggggcccgtaacggg

SEQ ID NO: 356379 - DNA, 601 bp, Homo sapiens
  misc_feature: GZ8MTXP01D8WQW.22.36.D03.1.454.CMB.2.raw
  modified_base (395)..(395): a, c, t, g, unknown or other
  misc_feature (395)..(395): n is a, c, g, or t
  modified_base (440)..(440): a, c, t, g, unknown or other
  misc_feature (440)..(440): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctcctgtgcagcctctggattcacagtcagcagcaatgccatgagttcggccgccgaggctccgaggggagggttgcgtaggtggtcgtcgggggtattgggaagtgatggtgccacacaactacgcagccgtccggtggacggggccncttcactcgatcctcagacgaacgtacttaaccgaaacacagtanaatcgtagactaaatcgtaacgacgcctcgacgaccgccggtacggaccgaccggtccgtaacttacgttcgtcggttacgtaacgtaaacgttacccgttcgtttacggttttcgggcccggtcgggtcccgtacgttacggtcggggccgtaaccgggg

SEQ ID NO: 356380 - DNA, 595 bp, Homo sapiens
  misc_feature: GZ8MTXP01DJWAB.22.36.D03.1.454.CMB.2.raw
  modified_base (299)..(299): a, c, t, g, unknown or other
  misc_feature (299)..(299): n is a, c, g, or t
  modified_base (388)..(388): a, c, t, g, unknown or other
  misc_feature (388)..(388): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcagcctctggattcacagtcagcagcaatgcatgagtggccncagctccgagggaagggttgcgaggtgggcgtcggggattgggaagtgagtggtgccacacaactaacgcagactccggtgacggggcncttcactcatcacagagacgtactaaccgaaacacgagtagaatcgtaggaactaagtacgtacgacgtcctcgacgaccgccggaacggaccgaccggtccgttaacctacgttcgtggttacggaacgtaacgttaccgttctttacgggttttcgggacccggtcgggtacccgtacgttaccgggtcggggccgtaacccggg

SEQ ID NO: 356381 - DNA, 554 bp, Homo sapiens
  misc_feature: GZ8MTXP01ALZVU.22.36.D03.1.454.CMB.2.raw
  modified_base (301)..(301): a, c, t, g, unknown or other
  misc_feature (301)..(301): n is a, c, g, or t
  modified_base (387)..(387): a, c, t, g, unknown or other
  misc_feature (387)..(387): n is a, c, g, or t
  modified_base (490)..(490): a, c, t, g, unknown or other
  misc_feature (490)..(490): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggagcttggtacgaggccggggggtcctgacactctcctgtgcagcctctggattcacagtcagcagcaatgccatgagttgggccncaggctccgaggggaagggttgcgagtgggtctggggattggaagtgatggtgccacacaactacgcagacctcgtggaggggccnctcatcatctccagacgacgacttaccgaaaacacagtagaatctaggacaaatgtaacacgcctcgacgcgccgaggaccgaccggccgtctacttcgtcgngtacgaaacgttccgttcttacgtttcgggccgtcggccgtacgttacgtcgggccgaaccggg

SEQ ID NO: 356382 - DNA, 545 bp, Homo sapiens
  misc_feature: GZ8MTXP01DPBL6.22.36.D03.1.454.CMB.2.raw
  modified_base (352)..(352): a, c, t, g, unknown or other
  misc_feature (352)..(352): n is a, c, g, or t
  modified_base (374)..(374): a, c, t, g, unknown or other
  misc_feature (374)..(374): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatgccatgagtggccgcaggctcgagggaggtgcagtggtctggggattggaagtgatggtacnccaacacactacgcagactcgnggacgggcgctcatcactctccagagacgactaaccgaaacacaggtagaatctagacgaaatgtaacacgcctcgacgccgccggaacggaccgacggtcccgttctacgttcgttgttcggacgtaaacgtaccttcgttacgttttcgggccgtccggccgtaaccgg

SEQ ID NO: 356383 - DNA, 590 bp, Homo sapiens
  misc_feature: GZ8MTXP01C4US7.22.36.D03.1.454.CMB.2.raw
  modified_base (206)..(206): a, c, t, g, unknown or other
  misc_feature (206)..(206): n is a, c, g, or t
  modified_base (329)..(329): a, c, t, g, unknown or other
  misc_feature (329)..(329): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtnttggagtcgtgggggaggcttggtacaggccggggggtcctgacactctcctgtgcagcctctggattcacagtcagcagcaatgccatgagttggccgccaggctccgagggggaagggttncgagtggggtctcgggggattggggaagtgatggtcgcccaagacacgtaacgcaaggactccgggtggacggggccgcttcgatcatctccgagacgacgataccgaaaacacaggtagaatctagacaaatcgtacaacgcctcgacgccgaccggaaggaccaccgggtccttacgttaaccgttcgttcggttcggaccgtaaaacgtacccttcgtttaacggttttccggggcccgtccgggccccgtaaccggg

SEQ ID NO: 356384 - DNA, 601 bp, Homo sapiens
  misc_feature: GZ8MTXP01DJ9R0.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacagtgactagttggtctttgactctgtctctgtaccaaacacacccacgaccaaacccccaatcatcatttatggtgtcacttcgtccggccctcgacggatctcctcatcgtcttctcagctcaagtctcgacaacgcgccctaccctaacatctcgtggcttaccgtagtttgaggacgtagttccttaactttacttacgtgtacttaacgtttacctttaaagtacggctcctaaccttcgttcggtttggtttccgggcggtaacggtccgaaccggtaaacgttcgacccgttccttaccggggttccacggtccccgaaacgggccctccgtccccccgttggtaacccttccgtttccccg

SEQ ID NO: 356385 - DNA, 574 bp, Homo sapiens
  misc_feature: GZ8MTXP01CTL6W.22.36.D03.1.454.CMB.2.raw
  modified_base (218)..(218): a, c, t, g, unknown or other
  misc_feature (218)..(218): n is a, c, g, or t
  modified_base (309)..(309): a, c, t, g, unknown or other
  misc_feature (309)..(309): n is a, c, g, or t
  modified_base (328)..(328): a, c, t, g, unknown or other
  misc_feature (328)..(328): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgactagttgggtctttgactctgtctcctggtaccaacaacacccagaccaaaccccccatcatcatttatgtntcactcgtcggccctgagntctcctcatcgcttcacagcctaccaagtctcggacaaccgacggccctactacctaaacctatcctcgtcgggaccttccgtagtttgaggtacgtagtacttaacttagttactggtactacgtttaccttaaaagttcggactaccctacttcttacggtttggtttcgggcggtacggcgtaccgagtcgacccgttcgttccggttcaacgcccgaagtccctcgcccctcggttcctccc

SEQ ID NO: 356386 - DNA, 572 bp, Homo sapiens
  misc_feature: GZ8MTXP01CSUIV.22.36.D03.1.454.CMB.2.raw
  modified_base (218)..(218): a, c, t, g, unknown or other
  misc_feature (218)..(218): n is a, c, g, or t
  modified_base (328)..(328): a, c, t, g, unknown or other
  misc_feature (328)..(328): n is a, c, g, or t
  modified_base (565)..(565): a, c, t, g, unknown or other
  misc_feature (565)..(565): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgactattgggtcttttgactctgtctctggtaccaacaacacccaggaccaaacccccatcatcatttatgtgtcactcgtcggcctcgaggntctcctcatcgcttctacaggtctaccaagtctcggacaacacggtaccctaccctaaccacttcctcgtcgggccttccgtagtttcgacgggtacgtacgtcttaactttattacgtcgtacttacgtttacctttaaagttcggccgtacctacttcgtcgttgggttttccggcggtaaggcacggtagttcgtaccgtcgttcgttcacgcccaggctcgccccttcggtcncgttccg

SEQ ID NO: 356387 - DNA, 518 bp, Homo sapiens
  misc_feature: GZ8MTXP01DUL8I.22.36.D03.1.454.CMB.2.raw
  modified_base (305)..(305): a, c, t, g, unknown or other
  misc_feature (305)..(305): n is a, c, g, or t
  modified_base (322)..(322): a, c, t, g, unknown or other
  misc_feature (322)..(322): n is a, c, g, or t
  modified_base (327)..(327): a, c, t, g, unknown or other
  misc_feature (327)..(327): n is a, c, g, or t
  modified_base (337)..(337): a, c, t, g, unknown or other
  misc_feature (337)..(337): n is a, c, g, or t
  modified_base (353)..(353): a, c, t, g, unknown or other
  misc_feature (353)..(353): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtctttgactctgtctctggtaccaacacacccagaccaaaccccccatcatcattatgtntcactcgtcgcctcagntctcncatcgcttcncagctcagtctgcacncgcctcctacatctctggctcgagttgagacgagtctacttattactgtctagttaccttaaattcgcgccacttctcgttggtttcggcggaacggcacggaacgttcgtaccgtccgttcgttcacgcccaaggtcctcgcccccgttggtcccgttctcccg

SEQ ID NO: 356388 - DNA, 618 bp, Homo sapiens
  misc_feature: GZ8MTXP01BLMJT.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactagttgggtctttgactctgtctctggtaccaacaacacccacggaccaaaccccccaactcatcatttatgtgtcactcgtcggcctcagagtctcctcatcgcttctcaggctcaagtctggacaacacggccctaccctaacactctcgtcgggctccagtttcgacggtacgagtctaactttacttacgtcgtacttacgtttacctttaaagttacggccgtcctaacttcgttcggttcggttttccgggcgggtaacggtcgttaccggtaagttccggtaacccgtcccgttccggggttccaccggaaccccgtaacgggtccccgttccggtcccccccgttacgggtccccttaaccggtttcccccg

SEQ ID NO: 356389 - DNA, 656 bp, Homo sapiens
  misc_feature: GZ8MTXP01A35IX.22.36.D03.1.454.CMB.2.raw
  modified_base (416)..(416): a, c, t, g, unknown or other
  misc_feature (416)..(416): n is a, c, g, or t
  modified_base (427)..(427): a, c, t, g, unknown or other
  misc_feature (427)..(427): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggtcgttggtacgaggcccggggggtccctgacactctcctgtcgcagcctctggattcacagtcagcagcaatgccatgagttcgggtcccgccgaggcctccggagggggtaaggggttgcgtaggtgggtcgtcgggggattggggaagtgatgggtacacccaacgacacgtaccgcgacgaccgtcggnggacggggccncttcgatcacttccgtccagaacgacgtaacttaacccggaaaactacgagggtagaactcgtacgaacctaaagttcgtaacgtacgtccgtcgaccggccggaccggaacggaccgttaccgggtcccgttacgttaccgtttcgttacggttcgaaccggtaaaccgtcccgttttcgtttaacggggttttccgggaccccggtccggttaacccgtaacccggg

SEQ ID NO: 356390 - DNA, 533 bp, Homo sapiens
  misc_feature: GZ8MTXP01AUJ5Y.22.36.D03.1.454.CMB.2.raw
  modified_base (215)..(215): a, c, t, g, unknown or other
  misc_feature (215)..(215): n is a, c, g, or t
  modified_base (306)..(306): a, c, t, g, unknown or other
  misc_feature (306)..(306): n is a, c, g, or t
  modified_base (322)..(322): a, c, t, g, unknown or other
  misc_feature (322)..(322): n is a, c, g, or t
  modified_base (494)..(494): a, c, t, g, unknown or other
  misc_feature (494)..(494): n is a, c, g, or t
  modified_base (520)..(520): a, c, t, g, unknown or other
  misc_feature (520)..(520): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagcatttccngcactgggaccaacagtgacattgggtcttttgactctgtctcctggtaccaacaacacccaggccaaaccccccatcatcatttatggtntcactcgtcggccctnaggactctctcatcgcttctcaaggctccaagtctggcaacacgcctaccctaacatctcgtgggctccagtttgagacgagttctacttattactggctagtttccttaaagttcgcgccactctcggtcggtttacggcgtaggcacgaagtcgaccgtccgtcggttcncgccaaggcctcgcccccgtggttcnccgttcgtccccg

SEQ ID NO: 356391 - DNA, 508 bp, Homo sapiens
  misc_feature: GZ8MTXP01DZFM8.22.36.D03.1.454.CMB.2.raw
  modified_base (219)..(219): a, c, t, g, unknown or other
  misc_feature (219)..(219): n is a, c, g, or t
  modified_base (251)..(251): a, c, t, g, unknown or other
  misc_feature (251)..(251): n is a, c, g, or t
  modified_base (375)..(375): a, c, t, g, unknown or other
  misc_feature (375)..(375): n is a, c, g, or t
  modified_base (503)..(503): a, c, t, g, unknown or other
  misc_feature (503)..(503): n is a, c, g, or t
  modified_base (505)..(505): a, c, t, g, unknown or other
  misc_feature (505)..(505): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgagggaaggggttgcagtgggtctcggggattggaagtgatggtgccacacactacgcagactccgtggaggggccncttcatcatctcagagacgattaccgaaaacnagtgaatctgcaaatgtacagcctcagcgcgaggacacggccgtctactctgtgacgaaagtacctctattttcggccgcggccgacctacgtgggccagggcaaccctggtcacgtctcttcngcctcacaaggcccatcggtctcccctgcgccctgctccagacgcacctcggagacgcacgagccgcctggctgcctgtcaggctacttccacgcgtatgttcgttggagcgggctgggcagggccgngngtg

SEQ ID NO: 356392 - DNA, 554 bp, Homo sapiens
  misc_feature: GZ8MTXP01D9F50.22.36.D03.1.454.CMB.2.raw
  modified_base (301)..(301): a, c, t, g, unknown or other
  misc_feature (301)..(301): n is a, c, g, or t
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
  modified_base (389)..(389): a, c, t, g, unknown or other
  misc_feature (389)..(389): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccggggggtccctgacactctcctgtgcagcctctggattcacagtcagcagcaatgccatgagttggccncaggctcgagggagggttgcaggtggcgtggggattggaagtgatggngccanacaacgtacncgagacctccggtggacgggggccnctttcactcactctaccagagacgacttaccgaaacacagtagaatctaggactaaatagtacacgcctcgacgaccgccgacggaccacggccgtctacttctgttgacgaacgttacgttcttagttttcggccgcggccgacgttacgtcgggccgaacggg

SEQ ID NO: 356393 - DNA, 660 bp, Homo sapiens
  misc_feature: GZ8MTXP01ES6FG.22.36.D03.1.454.CMB.2.raw
  modified_base (252)..(252): a, c, t, g, unknown or other
  misc_feature (252)..(252): n is a, c, g, or t
  modified_base (628)..(628): a, c, t, g, unknown or other
  misc_feature (628)..(628): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccgagggaaggggttgcagtgggtctcggggattggaagtgatggtgccacacactacgcagactccgtggagggccgcttcatcatctccagagacgattaccgaaaacncagtgaatctagacaaatgtacagcctcagcgccgaggacacggccgtctacttctgtgacgaaacgaccttcttagttttcgggccgcggccgacctacggtggggccgagggccaacccgtggtcaccgtctcttcacgcctccaccgaacgggcccactccgggtcctccccgcggtcccgccccgtcgccgtcccgaacgggacgaccgtaccccgtaccggggacggaaccgccaacccggaaccgggccccgggtccccgtccgggggtcccttccgggtcccgttcgggttaacccgaaacgggtaaccctttaaccgtttacccgaaccgttcgttaacgttcggttaccgttgggcggccgggggtntaacggggacgaaacgggcggtaaccaaggtg

SEQ ID NO: 356394 - DNA, 579 bp, Homo sapiens
  misc_feature: GZ8MTXP01B9G29.22.36.D03.1.454.CMB.2.raw
  modified_base (249)..(249): a, c, t, g, unknown or other
  misc_feature (249)..(249): n is a, c, g, or t
  modified_base (574)..(574): a, c, t, g, unknown or other
  misc_feature (574)..(574): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattaccgaaaacncagtgaatctgcaaatgtacagcctcagcgccgaggacacggccgtctacttctgtgcgaaagccttcttagttttcgggccgcggccgacctacgtggggccaggcaacccgtggtcaccgtctcttcacgcctccaccgacgggcccagtccggtccttcccccgtggcccgcccctgaccctccgacggcgccacccgtccgggacgacgccaacgcggcccggcccgtggggcctcgcccgttcggtaccgaagggtaaccttaccttccgacgttcgtagtcgttcgttcggacggcgggctgggacgagggccgaacgngtaag

SEQ ID NO: 356395 - DNA, 583 bp, Homo sapiens
  misc_feature: GZ8MTXP01CJZES.22.36.D03.1.454.CMB.2.raw
  modified_base (220)..(220): a, c, t, g, unknown or other
  misc_feature (220)..(220): n is a, c, g, or t
  modified_base (253)..(253): a, c, t, g, unknown or other
  misc_feature (253)..(253): n is a, c, g, or t
  modified_base (434)..(434): a, c, t, g, unknown or other
  misc_feature (434)..(434): n is a, c, g, or t
  modified_base (577)..(577): a, c, t, g, unknown or other
  misc_feature (577)..(577): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgaggggaagggttgcaggtgggtctcggggattggaagtgatggtgccacacactacgcagactccgtggaggggccncttcatcatctccagagacgattaccgaaaacncagtgaatctgacaaatgtacagcctcagcgcgaggacacggccgtctacttctgtgacgaaacgtacctcgttagttttcgggccgcggccgtaccgtacgtcggggccagggccaacccgtggtcaccgtctcttcacgcctccaccaacgggcccacgtccgtccttccccgtggccnccctgcctccgaggcgccaccgtccgggacgacgccacgacggcccggcccgtgggcctcggtccgtacggtacgaacgggtaaccttacgttcccgacgccgttagtcgttcgttggacggcgggcgtcggcgacgggccgngaagtg

SEQ ID NO: 356396 - DNA, 615 bp, Homo sapiens
  misc_feature: GZ8MTXP01AEGTP.22.36.D03.1.454.CMB.2.raw
  modified_base (368)..(368): a, c, t, g, unknown or other
  misc_feature (368)..(368): n is a, c, g, or t
  modified_base (404)..(404): a, c, t, g, unknown or other
  misc_feature (404)..(404): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggagcttggtacgaggccgggggggtccctgacactctcctgtgcagcctctggattcacagtcagcagcaatgccatggagttgggtccgtcaggctccgagggggaagggggttgcgaggtgggtcgtcgggggattgggaagtgatgggtnccacacaactacgcagacctccggtggacggggccncttcatcatctccagagacgactaccgaaacacagtagaatctaggacaaagtcgtaacacgccacgacggccgaccggtacggaccgaccgggtccgtccttaccttccgtggttacgaacgtaaacggttacccttcgtttacggtttttccggggcccggtccgggtccccggtaccgttaccgggtcgggggcccggtaacccgggg

SEQ ID NO: 356397 - DNA, 531 bp, Homo sapiens
  misc_feature: GZ8MTXP01DJMMI.22.36.D03.1.454.CMB.2.raw
  modified_base (328)..(328): a, c, t, g, unknown or other
  misc_feature (328)..(328): n is a, c, g, or t
  modified_base (362)..(362): a, c, t, g, unknown or other
  misc_feature (362)..(362): n is a, c, g, or t
  modified_base (524)..(524): a, c, t, g, unknown or other
  misc_feature (524)..(524): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtctttgactctgtctctggtaccaacaacacccaggaccaaaccccccaatcatcatttatgtgtcactcgtcggcctcaggntctctcatcgtctctcagctcaagtctggcaacncgcctccctaacactctctggctccgtagtttgaggacgtagtctacttattacgtgtcttagtttacctttaaagttacgcgtcctactctcgttggtttcggcggtaagcgacgacgttcgaccgtcgttcggttcacgtcccgagctcgcccttcgtcncgttccg

SEQ ID NO: 356398 - DNA, 554 bp, Homo sapiens
  misc_feature: GZ8MTXP01EGL9S.22.36.D03.1.454.CMB.2.raw
  modified_base (306)..(306): a, c, t, g, unknown or other
  misc_feature (306)..(306): n is a, c, g, or t
  modified_base (520)..(520): a, c, t, g, unknown or other
  misc_feature (520)..(520): n is a, c, g, or t
  modified_base (548)..(548): a, c, t, g, unknown or other
  misc_feature (548)..(548): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtctttgactctgtctctggtaccaacaacacccacgaccaaaccccccaatcatcatttangtgtcactcgtcggcctcaggactctcctcatcgcttctcaggtcctcaagtctacgggacaacgcggaccctaccctaaccacttctctcgggtcttaccgtagtttcgaggtacgacgttcttactttattactgtactagtttaccctttaaagtacgccgtcctacgtcttcggttggtttcggcggtaagcacgtaagttcgaccgtcncggttcacgccagctcgcccttcggtcncgttcc

SEQ ID NO: 356399 - DNA, 570 bp, Homo sapiens
  misc_feature: GZ8MTXP01CUQ2D.22.36.D03.1.454.CMB.2.raw
  modified_base (216)..(216): a, c, t, g, unknown or other
  misc_feature (216)..(216): n is a, c, g, or t
  modified_base (229)..(229): a, c, t, g, unknown or other
  misc_feature (229)..(229): n is a, c, g, or t
  modified_base (233)..(233): a, c, t, g, unknown or other
  misc_feature (233)..(233): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctgatcatctggacagtcgatcagcatttccngcacgtggacaanagtnatagttggtctttgactctgtctctagtaaccaaacaacaccacgaccaaacccccaactcatactaatttatgtcgtactactcgtccgcctacgagacgtctcctacatcgtcttctacacgctacaaagtctacgacaaacacgtccctacctaacatctcgtcgctacgtagttgagacgagtactaacttatacgtcgtactacttacttaaattacgtacgacctactcgttcgttcggttcggtcggaacggacgacgtaacgttacgtaccgtccgttccggttcgacgaaccgaacgccgtccgtccccgttccgtccgttccgtccg

SEQ ID NO: 356400 - DNA, 601 bp, Homo sapiens
  misc_feature: GZ8MTXP01CWFKP.22.36.D03.1.454.CMB.2.raw
  modified_base (364)..(364): a, c, t, g, unknown or other
  misc_feature (364)..(364): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtatggagtcgtgggggaggcttggtacaggccggggggtcctgacactctcctgtgcagcctctggattcacagtcagcagcaatgccatgagttgggccgcgaggcctccgagggggaagggggttgcgaggtggggtcgtcgggggattggaagtgagtgggtnccacacaactacgcagacctccggtggacggggccgctcatcactctccagagacgacttaaccgaaaacacagtagaatcaggacaaatcgtaacacgcctcagaccgccggaacggaccgacggcccgtaacgtaaccttcgtcgttcgaacgaaacgttacccgttcgttacgtttttcggggacccggtccgggcccggtaccgttaccggtccgggggcccgtaaccggggg

SEQ ID NO: 356401 - DNA, 548 bp, Homo sapiens
  misc_feature: GZ8MTXP01EWJOB.22.36.D03.1.454.CMB.2.raw
  modified_base (394)..(394): a, c, t, g, unknown or other
  misc_feature (394)..(394): n is a, c, g, or t
tcagacatacgcgtcacgaccggtgctcgatttagctgcgtcacgatctctcttggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccggggggtccctgacactctcctgtgcagcctctggattcacagtcagcagcaatgccatgagttgggtccgccaggctccgaggggaagggggttgcgaggtgggtctcgggggattggaagtgatggtgccacacaactacgcagactccggtgagggggccgnttcatcatctccagagacgattaccgaaacacagtagaatctggacaaatgtacagcctcacgcgccgaggacacggccgtctacttctcgttgacgaaagccgttcttacgttttcgggccgtcggccgacgttacgtcggggccgaacgggg

SEQ ID NO: 356402 - DNA, 610 bp, Homo sapiens
  misc_feature: GZ8MTXP01CNFN1.22.36.D03.1.454.CMB.2.raw
  modified_base (509)..(509): a, c, t, g, unknown or other
  misc_feature (509)..(509): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttgggtacgacgggcccgggggggtcctgacactctcctgtgcagcctctggattcacagtcagcagcaatcgccatggagttcgggccgccgagggcctaccgagggggaaggggttgcgagggtggggtcgtcgggggtattaggggaagtggaacgtgggtacgacccaacgacaccgtacggcaggaccgtccggtagggacgggccgacgttcagtcatctacagacgacgacgttaccgaaacacaggtgaatctagacaagtcgtacacgcctacncgcgccgaacggaccgacggtcccggttcttaccgttcgttcggttcgacgtaaacgtcccttcgtttacggttttcgggcccgtccgggcccgtaaccgg

SEQ ID NO: 356403 - DNA, 666 bp, Homo sapiens
  misc_feature: GZ8MTXP01EJFD8.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacgaggccggggggtccctgacactctcctgtgcagcctctggattcacagtcagcagcaatgccatgtaggttcgggtccgccgaggcctccggaagggggtaagggggttgcgtagggtgggtcgtacgggggtattggaaagtgagtggtcgccacacaactacgcagaccgtccggtaggacgggggccctcgttcactcaactctaccgagacgaacgtacgttaaccgaaaacacgaagtagtaatcgtacggaactaaagtcgtaacacgtcccgacgacggaccggaccggtaacgggaccgaacccgggtccgttaaccgttaaccgttcgttacgggttaccgaacggtaaaacgttcccgttcgtttacggttttccggggcccgtccgggtacccgtacggttaccggtccggggcccggtaacccggg

SEQ ID NO: 356404 - DNA, 519 bp, Homo sapiens
  misc_feature: GZ8MTXP01DL3GQ.22.36.D03.1.454.CMB.2.raw
  modified_base (216)..(216): a, c, t, g, unknown or other
  misc_feature (216)..(216): n is a, c, g, or t
  modified_base (412)..(412): a, c, t, g, unknown or other
  misc_feature (412)..(412): n is a, c, g, or t
  modified_base (424)..(424): a, c, t, g, unknown or other
  misc_feature (424)..(424): n is a, c, g, or t
  modified_base (438)..(438): a, c, t, g, unknown or other
  misc_feature (438)..(438): n is a, c, g, or t
  modified_base (502)..(502): a, c, t, g, unknown or other
  misc_feature (502)..(502): n is a, c, g, or t
  modified_base (514)..(514): a, c, t, g, unknown or other
  misc_feature (514)..(514): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccnttcatcatctccagagacgattaccgaaaacacagtgaatctgcaaatgtacagcctcagcgcgaggacacggccgtctacttctgtgcgaaagtacctctatttttcgggccgcggccgacctacgtggggccagggcaaccctgtcacgtctcttcacgcctcaccaacgggcccatcggtcttcccctggccnccctgcctcagngccacctcggacgngcacgagccggcctgggctcgcctgcaaggctacttccacgcgtatgttcgttggacgtcgggntcggcaggcgcngtaag

SEQ ID NO: 356405 - DNA, 630 bp, Homo sapiens
  misc_feature: GZ8MTXP01AFGZB.22.36.D03.1.454.CMB.2.raw
  modified_base (360)..(360): a, c, t, g, unknown or other
  misc_feature (360)..(360): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtcctgacactctcctgtgcagcctctggattcacagtcagcagcaatgccatgagttggcctcaggctccgaggggaagggttgcgtagggtcggtcggtgggtagtaggagtgtagtggtcncacacgtaacgtacgcgagtacccgtcggtagggaccggggcctcttcgactctactcctaccgagacgaacgtacgtaaaccgaaaacacgtagtaagtaacttcgacgggtaaactaaagttccgtaacgcgtcccgacgacggcccggaccggacggaccgaccggtccgtaacctacgttcgtcgttcgaaccgtaaacgttcccgttgtttacggtttccgggccgtccggtaccgtacgttacgggtccgggccgtaacccggg

SEQ ID NO: 356406 - DNA, 628 bp, Homo sapiens
  misc_feature: GZ8MTXP01AECUF.22.36.D03.1.454.CMB.2.raw
  modified_base (298)..(298): a, c, t, g, unknown or other
  misc_feature (298)..(298): n is a, c, g, or t
  modified_base (401)..(401): a, c, t, g, unknown or other
  misc_feature (401)..(401): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctcctgtgcagcctctggattcacagtcagcagcaatgccatgagttggccncaggctccgaggggaaggggttgcgtaggtggggtcgtcgggggattgggaagtgacgtgggtcgaccacacgaactacgcagaccgtcggtggacggggccnttcactcactctccagacgaacgacttaccgaaaacacgagtagaatcgtacggacaaatcgtaacacgccctcgacggcccgaccggacggaaccgccgggaccgttcctaaccgtttcgtacgttacgtaaccggtaaacgttacccgttacgtttacggtttttcggggacccggtccgggtacccggtaccgttaccgggttccggggcccggtaacccgggg

SEQ ID NO: 356407 - DNA, 675 bp, Homo sapiens
  misc_feature: GZ8MTXP01ENNVN.22.36.D03.1.454.CMB.2.raw
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaaccaacagtgactagttgggtctttgactctgtctctgtaccaacaacacccacgaccaaccccccatcatctattangtntcactcgtcgcctgagtgtctctcatccgtcttctacgaggtcctaccaaacgtctcgggacctaaacgacccgggtccctaccctaaacctacttccgtcgtcgggtccttaccgtaggttttcggaacgggtacgtacgttaccttaactttacgtttacgtcgtaccgtttaacgtttaccctttaaaagtttcggccgtacctacttccggttcgtttacgggttttcgggacggtaacggtaccgaccggtaacggttcggtaacccgttcccggttaccggttccgacccggtaaccccggtaacggtcccgttaccccggtcccccggttaccggttcccgttaacccgtttccccgg

SEQ ID NO: 356408 - DNA, 641 bp, Homo sapiens
  misc_feature: GZ8MTXP01CPTOC.22.36.D03.1.454.CMB.2.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcatcagctatttccgngacacgtacggaaccaagagtagactagttggttctttcgtactctcgtctacgtacgtaaccaaacaaccacccgaaccgaaccccaaacccccaactactactactatttagtcgtacgtactacgtcgtccgtcctacgacggtctctcctactactcgtctctacgacgtctacgtaacgtcgtacgaccaaccgaccgtaccctaccctaactactctcgtcgtctacgtagttacgacgtacgtatacttacttattacgtcgtacttacgttacttaagtcgcctacctacgttcgttcggttcggttcggacggtaacggtacgacggtaacgttccgtaccgttccgttccggttccgaccggtaacccgtaacgtcccgtacccgtccccgttacgtcccttaaccgttcccg

SEQ ID NO: 356409 - DNA, 611 bp, Homo sapiens
  misc_feature: GZ8MTXP01BMCLW.22.36.D03.1.454.CMB.2.raw
  modified_base (313)..(313): a, c, t, g, unknown or other
  misc_feature (313)..(313): n is a, c, g, or t
  modified_base (331)..(331): a, c, t, g, unknown or other
  misc_feature (331)..(331): n is a, c, g, or t
  modified_base (365)..(365): a, c, t, g, unknown or other
  misc_feature (365)..(365): n is a, c, g, or t
tcagacatacgcgtcacgaccggtgctcgatttagctgcgtcacgatctctcttggggtggggtctcaggaggcagtgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaaccaacagtgactagttgggtcttttgactctgtctcctgtaccaacaacacccacgaccaaaccccccaactcatcatttatgtntcactcgtcgcctcaggntctctcatcgcttctcagctcaagtctcgcaacncgccctccctaaccatctctcggtctaccgtagtttgaggtacgatctacttattacgtgtctacgtttacctttaaagtacggtcctacctacttccgttcggttcgggttttccgggcgggtaacggccgttaaccgggtaacgttccggaacccgttccccggttacggttaccgacccggtaaccccgaaaggtcccgttaccccgggccccccgttacgggtcccttaacccgtttccccg

SEQ ID NO: 356410 - DNA, 541 bp, Homo sapiens
  misc_feature: GZ8MTXP01D821E.22.36.D03.1.454.CMB.2.raw
  modified_base (324)..(324): a, c, t, g, unknown or other
  misc_feature (324)..(324): n is a, c, g, or t
  modified_base (359)..(359): a, c, t, g, unknown or other
  misc_feature (359)..(359): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (403)..(403): a, c, t, g, unknown or other
  misc_feature (403)..(403): n is a, c, g, or t
  modified_base (430)..(430): a, c, t, g, unknown or other
  misc_feature (430)..(430): n is a, c, g, or t
  modified_base (432)..(433): a, c, t, g, unknown or other
  misc_feature (432)..(433): n is a, c, g, or t
  modified_base (436)..(436): a, c, t, g, unknown or other
  misc_feature (436)..(436): n is a, c, g, or t
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
  modified_base (446)..(446): a, c, t, g, unknown or other
  misc_feature (446)..(446): n is a, c, g, or t
  modified_base (448)..(448): a, c, t, g, unknown or other
  misc_feature (448)..(448): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacagccgggggggtccctgacactctcctgtgcagcctctggattcacagtcagcagcaatgccatgagttgggccgccaggctccgagggaaggggttncagtgggtctcgggggattgggaagtgactgggtnccacacaactacgcagactccgngagggggccncttcatcatcnccagagacgattccgaaaacacagtanannganaatananacncncacgcgcgacgacgacgcgtctcttctgttgacgaaacgttacgttcttacgtttcgggtccggccggccgacgttacgtcgggccggaacgg

SEQ ID NO: 356411 - DNA, 580 bp, Homo sapiens
  misc_feature: GZ8MTXP01EZRK6.22.36.D03.1.454.CMB.2.raw
  modified_base (311)..(311): a, c, t, g, unknown or other
  misc_feature (311)..(311): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccgggggggtccctgacactctcctgtgcagcctctggattcacagtcagcagcaatgccatgagttcgggtccnccaggctccgagggggaagggttgcgaggtggggtctcgggggatttgggaagtggatgggtacgcccaacacacgtacgcaagactcggtggacgggccgcgttcatcatcctaccagacgacgacttaccgaaaacacaggtagaaatctagacaaagtgtaacacgtcctacgacgccggccgaagggaccgacggcccgttctacttcgttagttcgacgaaacggtccttaacttacgttttcgggcccgtcgggccgtaaccg

SEQ ID NO: 356412 - DNA, 622 bp, Homo sapiens
  misc_feature: GZ8MTXP01DPIS3.22.36.D03.1.454.CMB.2.raw
  modified_base (303)..(303): a, c, t, g, unknown or other
  misc_feature (303)..(303): n is a, c, g, or t
  modified_base (307)..(307): a, c, t, g, unknown or other
  misc_feature (307)..(307): n is a, c, g, or t
  modified_base (321)..(321): a, c, t, g, unknown or other
  misc_feature (321)..(321): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattggtctttgactctgtctctgtaccaacaacacccacgccaaaccccccaatcatcatttanggtntcacttcgcgcctnaggntctccncatcgcttcncagctacaagtctaggaccaacgacggtccctaccctaacatctcgtcggctaccgtagtttgacggactagtcttacttacttagtcgtacttacgtttaccgtttaaagtcggctacctacgttccgttcgggtttcgggttttccggcgggtaacggtccgttaaaccggtaacggttccggtaaccccggttccgttaccgggttccgaaccggtaaccccgaaacgggtcccgttcccggccccccggttcggttaacccttaacccgtttccccg

SEQ ID NO: 356413 - DNA, 527 bp, Homo sapiens
  misc_feature: GZ8MTXP01A7Y80.22.36.D03.1.454.CMB.2.raw
  modified_base (217)..(217): a, c, t, g, unknown or other
  misc_feature (217)..(217): n is a, c, g, or t
  modified_base (249)..(249): a, c, t, g, unknown or other
  misc_feature (249)..(249): n is a, c, g, or t
  modified_base (446)..(446): a, c, t, g, unknown or other
  misc_feature (446)..(446): n is a, c, g, or t
  modified_base (524)..(524): a, c, t, g, unknown or other
  misc_feature (524)..(524): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattccgaaaacncagtgaatctgacaaatgtacagcctcagcgccgaggacacggccgtctacttctgtgacgaaagacctctagttttggccgcggccgactacgtggggccagggcaacccgtgtcaccgtctctcagcctcaccaggcccatccggtctcccccgtggcccgccctgctccgagacgcacctcggagacgccacgngccgcctgggctcgctggtcaaggctacttccgacgcgtagtgttcgttggacggcgggctgggccaggccgtaacgngtg

SEQ ID NO: 356414 - DNA, 620 bp, Homo sapiens
  misc_feature: GZ8MTXP01EBAV8.22.36.D03.1.454.CMB.2.raw
  modified_base (319)..(319): a, c, t, g, unknown or other
  misc_feature (319)..(319): n is a, c, g, or t
  modified_base (337)..(337): a, c, t, g, unknown or other
  misc_feature (337)..(337): n is a, c, g, or t
  modified_base (358)..(358): a, c, t, g, unknown or other
  misc_feature (358)..(358): n is a, c, g, or t
  modified_base (411)..(411): a, c, t, g, unknown or other
  misc_feature (411)..(411): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtccctgacactctcctgtgcagcctctggattcacagtcagcagcaatgccatgagttggccgcaggctcgagggagggttncgaggtggtcgtgggggnttggaagtgagtggtgcccanaccaacctacgcgaagtaccgtcccggtgggacgggggcctcttcatcactcnccagaacgacgtaacttaaccgaaaacacgagtagaaattccgtagggaactaaagttacgtaaccaacggccctacgacgaccgaccggacggaccgaccggccgtcttaacttcgtcgttacgacgtaaacgttaccttcgttacggttttccgggacccggtccgggtacccggtaccgttacggttccggggccgtaacccgggg

SEQ ID NO: 356415 - DNA, 689 bp, Homo sapiens
  misc_feature: GZ8MTXP01BNVLB.22.36.D03.1.454.CMB.2.raw
  modified_base (221)..(221): a, c, t, g, unknown or other
  misc_feature (221)..(221): n is a, c, g, or t
  modified_base (313)..(313): a, c, t, g, unknown or other
  misc_feature (313)..(313): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctcgccctgacccagcctgcctccgtgtctggatcatctggacagtcgatcagctactttccngcacgtcgggaccaacagtgactagttgggttctttgactctgtctctacgtaccaacaaccaccacgaccaacccccatcatctatttagnggtctcaccgtcgtccggcctacgaggtcttcctcctcgtacttccgtcctttccacgaaccgggtccctaccgtacggttccgtacggaccaaccgtacccggtaccccttacccctaactccttccgtccggtcgggtacccttacccggtaaggttttacgggacggttaaccgtacgttaccttaacgtttactttaacgtcggttaccgttacgtttaacctttaaacgtccgggaccttcccgtacgttccggtttcggtttcggtttccgggcgggtaacgccgaaacggtacgttccggtacccgtcccgttcggttccgaccgtccccgagggtcctccccggtcccttcggtcccttcgttccccg

SEQ ID NO: 356416 - DNA, 589 bp, Homo sapiens
  misc_feature: GZ8MTXP01DV9W8.22.36.D03.1.454.CMB.2.raw
  modified_base (309)..(309): a, c, t, g, unknown or other
  misc_feature (309)..(309): n is a, c, g, or t
  modified_base (415)..(415): a, c, t, g, unknown or other
  misc_feature (415)..(415): n is a, c, g, or t
  modified_base (450)..(450): a, c, t, g, unknown or other
  misc_feature (450)..(450): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggagtcttggtacgaggccggggggtcctgacactctcctgtgcagcctctggattcacagtcagcagcaatgccatgagttcgggccncgaggctccgagggggtaaggggttgcgtaggtggggtcgtcgggggtattggggaaagtgagtggtacgccaacacacgtacgcagacgtcggtggacggggccncttcatcatctccagacgacgactaaccgaaaacncaggtacgaatcgtagacaaatcgaacacgcctacgacgccgaccggaacggaccgaccgggtccttacgttaaccgttcgttacggttcgacgtaaacgtccttcgtttacggtttccgggccgtccggccgtaaccg

SEQ ID NO: 356417 - DNA, 548 bp, Homo sapiens
  misc_feature: GZ8MTXP01C0B8K.22.36.D03.1.454.CMB.2.raw
  modified_base (325)..(325): a, c, t, g, unknown or other
  misc_feature (325)..(325): n is a, c, g, or t
  modified_base (351)..(351): a, c, t, g, unknown or other
  misc_feature (351)..(351): n is a, c, g, or t
  modified_base (541)..(541): a, c, t, g, unknown or other
  misc_feature (541)..(541): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaatcatcatttatggtgtcactcgtcggccctnaggagtctcctcatcgcttctcagcncaagtctggcaacacgcctaccctaacactctctgggctccgagtttgaggacgcgtcttacttattacgtgtactagtttaccctttaaattacggccgtacctacttctcggttggtttccggcggaaggcacgtaagttcgaccgtccttcggttcaggtccccaaggcctcgccccgttcggtccncgttccg

SEQ ID NO: 356418 - DNA, 559 bp, Homo sapiens
  misc_feature: GZ8MTXP01DC7PO.22.36.D03.1.454.CMB.2.raw
  modified_base (302)..(302): a, c, t, g, unknown or other
  misc_feature (302)..(302): n is a, c, g, or t
  modified_base (362)..(362): a, c, t, g, unknown or other
  misc_feature (362)..(362): n is a, c, g, or t
  modified_base (393)..(393): a, c, t, g, unknown or other
  misc_feature (393)..(393): n is a, c, g, or t
  modified_base (431)..(431): a, c, t, g, unknown or other
  misc_feature (431)..(431): n is a, c, g, or t
  modified_base (458)..(458): a, c, t, g, unknown or other
  misc_feature (458)..(458): n is a, c, g, or t
  modified_base (473)..(473): a, c, t, g, unknown or other
  misc_feature (473)..(473): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccggggggtccctgacactctcctgtgcagcctctggattcacagtcagcagcaatgccatgagttgggccncaggctccgaggggaagggttgcgaggtgggctgggggattgggaagtgatggtgccacncaactacgcaagactcccggtgacggggccnttcatcatctccagagaacgactaccgaaacacgaagngaatctaggacaaagtgtacagccctnacgcgccgtagaccnccggccgtctacttctcgttgacgaaacgttaccttcttacgttttcggaccctaaccgggccacgttacggtcgggccgaacggg

SEQ ID NO: 356419 - DNA, 662 bp, Homo sapiens
  misc_feature: GZ8MTXP01BORS0.22.36.D03.1.454.CMB.2.raw
  modified_base (217)..(217): a, c, t, g, unknown or other
  misc_feature (217)..(217): n is a, c, g, or t
  modified_base (404)..(404): a, c, t, g, unknown or other
  misc_feature (404)..(404): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagcatttccgngcacgtggaaccaagagtagactagtttgggttcttttgacttcgtcgttcctccgtacgtaacccaaaccaaacccaacccgaaccgaacccccaaaaccccccctaactacctactactaatttagtcggtacgtacctaccgtccggtccgtccctacgacggtactctctccactcgtcttcncgaacgtcctccgagtctacgaccaaccgaccgaccctaccctaactctctcgtcggtcctacgttagttacgacgtacgtacgttacttaacttattactaggtacttacgtttaaccttaaagtacgcctaccgtacgttcgttcggttcggttaccggcggtacggaaccgtaaccggttacgtccgaccgtccgtcggttaccgccgacccgaacggtcccgtcccgtccccgtcgttacctccgttccgtccg

SEQ ID NO: 356420 - DNA, 624 bp, Homo sapiens
  misc_feature: GZ8MTXP01DO7GH.22.36.D03.1.454.CMB.2.raw
  modified_base (218)..(218): a, c, t, g, unknown or other
  misc_feature (218)..(218): n is a, c, g, or t
  modified_base (371)..(371): a, c, t, g, unknown or other
  misc_feature (371)..(371): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtacggaaccaagagtgactagtttcggttctttcgctctcgtctccgtacgtaaccaaacaaccacccgaaccgaaccccaaacccccaactactactactattagtgtctctacgtcgtccgcctcgacgtctctctcactctctcncgacgtctcgtagtcgacgaccaaccgaccgtaccctaccctaactactcctcgtcggtcctacgtagttacgacgtacgtacgttacttaacttacttacgtacgtacttaacgtttaacttaaagtcgcctcctacgttcgttcggttcggttcggcggtacggaaccgtacggttaacgtccgttacccgtccgtcgttccgcgacccgaacggtccgtcccgtccccgtcgttcctccgttccgtcccg

SEQ ID NO: 356421 - DNA, 527 bp, Homo sapiens
  misc_feature: GZ8MTXP01DENC6.22.36.D03.1.454.CMB.2.raw
  modified_base (217)..(217): a, c, t, g, unknown or other
  misc_feature (217)..(217): n is a, c, g, or t
  modified_base (440)..(440): a, c, t, g, unknown or other
  misc_feature (440)..(440): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatgggtgccacacactacgcagactccgtgagggccnttcatcatctccagagacgattaccgaaaacacagtgaatctgcaaatgtacagcctcagcgcgaggacacggccgtctacttctgtgcgaaagtacctcttagtttttcgggccgcggcccgactacgtggggccagggccaaccctggtcaccgtctcttcacgctccaccaagggcccatcggtccttcccctgcgccctgctccagcgcacctcggagngcacgagccgcctgggctcgcctggtcaaggctacttccacgcgtatgttccgttggacgcgggactcgggcacgggcgcgaataag

SEQ ID NO: 356422 - DNA, 558 bp, Homo sapiens
  misc_feature: GZ8MTXP01AOGWQ.22.36.D03.1.454.CMB.2.raw
  modified_base (303)..(303): a, c, t, g, unknown or other
  misc_feature (303)..(303): n is a, c, g, or t
  modified_base (323)..(323): a, c, t, g, unknown or other
  misc_feature (323)..(323): n is a, c, g, or t
  modified_base (359)..(359): a, c, t, g, unknown or other
  misc_feature (359)..(359): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttggtacgaggccgggggggtccctgacactctcctgtgcagcctctggattcacagtcagcagcaatgccatgagttggccncaggctccgagggaggggtncgagtgggtctgggggattggaagtgatggtgccanacaactacgcacgacgtccggtggacggggccacttcatcactctccgagacgacgacttaccgaaacacagtagaatctggacaaatcgtacacgcctcacgcgccgacgaccgacggccgtctacttcgtcgttcgacgaacgaccgttcttacgttttcgggccgcggtccgacgttacgtcgggttccgaacggg

SEQ ID NO: 356423 - DNA, 588 bp, Homo sapiens
  misc_feature: GZ8MTXP01B44M2.22.36.D03.1.454.CMB.2.raw
  modified_base (225)..(225): a, c, t, g, unknown or other
  misc_feature (225)..(225): n is a, c, g, or t
  modified_base (258)..(258): a, c, t, g, unknown or other
  misc_feature (258)..(258): n is a, c, g, or t
  modified_base (464)..(464): a, c, t, g, unknown or other
  misc_feature (464)..(464): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccgaggggaaggggttgcaggtgggtctcgggggattggaagtgatggtgccacacactacgcagactccggtggacggggccncttcatcatctccagagacgattaccgaaaacncagtgaatctgcaaatgtacagcctcagcgccgaggacacggccgtctacttcgtgtcgacgaaagacctcgttaagtttttcgggccgtcggccgacccgtacgtcggggcccacggggccaacccgtggtccaccgtctcttcacgccctccaccgacgggcccagtccggtccttccccgtggcccgccctgcctccacggcnccaccgtccgggagtacgccaaccgacggccggcccgtgggcctcggtcccgtggtccaacgggtctacctttccgaccgcgtatcgttacgttggacggcgggcgtggcgaggcgcgaagtcg

SEQ ID NO: 356424 - DNA, 654 bp, Homo sapiens
  misc_feature: GZ8MTXP01C7PAT.22.36.D03.1.454.CMB.2.raw
  modified_base (312)..(312): a, c, t, g, unknown or other
  misc_feature (312)..(312): n is a, c, g, or t
  modified_base (315)..(315): a, c, t, g, unknown or other
  misc_feature (315)..(315): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggacccaacagtgactattgggttcttttgactctgtctcctggtaccaacaacaccccacggaccaaaccccccaatcatcatttangtntcactcgcgcctnagntctctcatcgtcttctacagtcctccaagtctggaccaaccgaccggccctaccctaacactctcgtcgggtcctaccgtagtttgaacggacgtacgtacttaactttacttacgtcgtaccttaagtttacctttaaagttacgccgtacctacgttccgttcggttcgggtttccggcgggtaacggtccgttaccggtaaacggttccggtaaaccccggttcccgttaccgggttcccaaccgggtaacccccgtaaaccgggtcccgttccccgggtccccccggtttacgggttccccttaacccgttttcccccg

SEQ ID NO: 356425 - DNA, 629 bp, Homo sapiens
  misc_feature: GZ8MTXP01EC1OL.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgactattgggtctttgactctgtcctcgtacgtaccaaacaccaccgacgaccccaaacccccatcactctatttagtggtcgtacaccgttcgtccgtcctacgaggtctcctcctctacgtcgtcttcaacgacgtcctacgtaagtccgtacggacctaaccgaccgtccccttacccctaactactcgtcgtacggccttaccgttaggtttagacggacgttacgtactttaactttacttacgtcgtacgtttacgtttaaccgtttaaagtcggcctacctacgttcgttacggtttcggtttcgggcggtcgtaccgacgtacgttcgtaccgtccgttcgttcgacgccgtacgccgtcccgcccgttcgtccttccgttcccg

SEQ ID NO: 356426 - DNA, 560 bp, Homo sapiens
  misc_feature: GZ8MTXP01CIXBN.22.36.D03.1.454.CMB.2.raw
  modified_base (353)..(353): a, c, t, g, unknown or other
  misc_feature (353)..(353): n is a, c, g, or t
  modified_base (392)..(392): a, c, t, g, unknown or other
  misc_feature (392)..(392): n is a, c, g, or t
  modified_base (455)..(455): a, c, t, g, unknown or other
  misc_feature (455)..(455): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggagcttggtacgaggccggggggtccctgacactctcctgtgcagcctctggattcacagtcagcagcaatgccatgagttggccgcaggctcgaggggaggttgcgaggtgggtctgggggattggagtgagtggtnccgacacaactacgcacgacctccggtaggacggggccncttcactcatctacagagacgataccgaaacacagtagaatctaggactaaatgtacacgccncgagcgaccggaggacgaccggccgtctacttcgtcgcgacgtaacgttaccttcgttacgttttcgggccggtcggaccgtacgttacgtcgggcggaaccggg

SEQ ID NO: 356427 - DNA, 538 bp, Homo sapiens
  misc_feature: GZ8MTXP01B2YPQ.22.36.D03.1.454.CMB.2.raw
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (387)..(387): a, c, t, g, unknown or other
  misc_feature (387)..(387): n is a, c, g, or t
  modified_base (518)..(518): a, c, t, g, unknown or other
  misc_feature (518)..(518): n is a, c, g, or t
  modified_base (531)..(531): a, c, t, g, unknown or other
  misc_feature (531)..(531): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaatcatcatttatggtgtcactcgtcggacctcagagtctcctcatcgctctcagctcaagtctgcacncgcctccacntcnctggctcagttnagacgatctattattactgtctagtttaccttaaagttacggcgtacctacttccgttcgttcgggttttacgggcggtaacggcgaccggtaagttcgtaccgtcgttacggttcacgtcccaggtctcnccccgttggtccncgttccg

SEQ ID NO: 356428 - DNA, 608 bp, Homo sapiens
  misc_feature: GZ8MTXP01EIQIQ.22.36.D03.1.454.CMB.2.raw
  modified_base (364)..(364): a, c, t, g, unknown or other
  misc_feature (364)..(364): n is a, c, g, or t
  modified_base (380)..(380): a, c, t, g, unknown or other
  misc_feature (380)..(380): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactagttgggtcttttgactctgtctcctgtaccaacaacacccagaccaaaccccccactcatctatttatgtgtcactcgtcggcctcaggagtctctcatcgctctcagctacagtctgacaacncgcctaccctacatcncgtgggctccgtagttgacggacgtagtctaactttattacgtcgtacttaacgtttacctttaaagttcggcctcctaacgttcttcgggttcgggtttttccgggacgggtaacgggtaccgaccggtaaacggttcgaaccccggttcccgttccggggttcacccggccccgtaaacgggtcccgttcccggcccccgttccgggtcccttaaccgtttccccg

SEQ ID NO: 356429 - DNA, 652 bp, Homo sapiens
  misc_feature: GZ8MTXP01AQHI8.22.36.D03.1.454.CMB.2.raw
  modified_base (219)..(219): a, c, t, g, unknown or other
  misc_feature (219)..(219): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccgngcacgtggaccaagagtgactagtttggttctttgactctgtctccgtacgaaccaacaaccaccgacgacccaaaccccactactactactattagtgtcgtctactccgtccggtccgtacgagtacgtctctcctactcgtcttcctcgtaacgtcctccgtacgtcgtacggaccaaccgaccgtaccctaccctaacctacttcctcgtcggtcctaccgtagttacgacggtacgtacgttacttaacttacttacgtcggtacgttacgtttaaccgtttaacgtacggccgtcctaccgttcgttcggtttccgggttacggtcgggtacggaaccgtaaccggttacggtccgttacccgttccgtcgttcgccgacccgaacggtccctcccgtccccgtccgttctaacccgttccgtcccg

SEQ ID NO: 356430 - DNA, 559 bp, Homo sapiens
  misc_feature: GZ8MTXP01A23X3.22.36.D03.1.454.CMB.2.raw
  modified_base (217)..(217): a, c, t, g, unknown or other
  misc_feature (217)..(217): n is a, c, g, or t
  modified_base (314)..(314): a, c, t, g, unknown or other
  misc_feature (314)..(314): n is a, c, g, or t
  modified_base (459)..(459): a, c, t, g, unknown or other
  misc_feature (459)..(459): n is a, c, g, or t
  modified_base (487)..(487): a, c, t, g, unknown or other
  misc_feature (487)..(487): n is a, c, g, or t
  modified_base (532)..(532): a, c, t, g, unknown or other
  misc_feature (532)..(532): n is a, c, g, or t
tcagacatacgcgtcacgaccggtgctcgatttagctgcgtcacgatctctcgttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacagttgggtcttttgactctgtctcctggtaccaacaacacccacggccaaacccccccaactcatctatttatggtntcactcgtcggccctcaggagtctctccatcgcttctcgagcctccaagtctgggcaacacggcctaccctaaccactctctgggctcctagtttgagacgagtcttaacttattactgggtctagtttacctttaaataggtcncctacttcgtcgttgggttttcggcggnggcaccggaagtcgaccgtccgtcgggttcacgcccgaaggtccnccgcccctcggttcctcgttcgtcccg

SEQ ID NO: 356431 - DNA, 608 bp, Homo sapiens
  misc_feature: GZ8MTXP01C4CSF.22.36.D03.1.454.CMB.2.raw
  modified_base (218)..(218): a, c, t, g, unknown or other
  misc_feature (218)..(218): n is a, c, g, or t
  modified_base (327)..(327): a, c, t, g, unknown or other
  misc_feature (327)..(327): n is a, c, g, or t
  modified_base (332)..(332): a, c, t, g, unknown or other
  misc_feature (332)..(332): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgactattgggtcttttgactctgtctctggtaccaacaacacccacggaccaaaccccccactcatcatttactggtctcactcgcggcctnacggngtctcctcatcgtcttctacacggtctaccaagtctcggacaacgcgaccctaccctaacactctcgtcgggacctccgtagtttggacggtacgtacgtcttaacttactttactcgtcttaacgtttaccctttaaaagttcgccgttcctaacttccgttcggtttcgggttttccgggcgggtaacgtcgttaacccggtaagttcggtaacccgttcgttaccgggttcacggtaacccaggccttcgccccttcggtccttaacgttccc

SEQ ID NO: 356432 - DNA, 614 bp, Homo sapiens
  misc_feature: GZ8MTXP01B19K2.22.36.D03.1.454.CMB.2.raw
  modified_base (308)..(308): a, c, t, g, unknown or other
  misc_feature (308)..(308): n is a, c, g, or t
  modified_base (370)..(370): a, c, t, g, unknown or other
  misc_feature (370)..(370): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacaccccaggccaaacccccccaatcatcatttanggtgtcactcgtcggccctcaggagtctcctcatcgcttctcaggctccaagtctggcaacncggccctccctacatctctgggctccagtttgaggacgagtctacttattacgtgtctacgtttaccctttaaattacggccgtccaaccttccgttcggttcgggtttttccgggcgggtaacgggtccgaacccggtaacggttcggtaaccccggttccggttacccgggttccgaaccgggtccccgaaaaggggtcccttccggcccccccgttcggggttcccttaaccgtttccccg

SEQ ID NO: 356433 - DNA, 612 bp, Homo sapiens
  misc_feature: GZ8MTXP01EY27E.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaaccaacagtgactagttgggttctttgactctgtctctgtaccaacaaccacccacgacccttaaaccccccactcactctatttatgtcgtcacgtcgtcggcctcgaggcgtctcctcatcgtctctcacgctccaagtctggaccaacgaccgtccctaccctaacctactctcgtcgggtctaccgtaggtttacgacggacgtacgtacttaacttattacgtcgtacgttacgtttacctttaaagttcgtccgtacctacttcgttcggtttcgggtttcgggcggtaacggcgttaaccggtaacggttcgtacccgtccgttcggttcgacggtcccgaacggtccgtccgccccttcggtccttccgttcccg

SEQ ID NO: 356434 - DNA, 589 bp, Homo sapiens
  misc_feature: GZ8MTXP01EQGBQ.22.36.D03.1.454.CMB.2.raw
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgactagttggtctttgactctgtctctgtaccaacaacacccacgaccaaaccccccatcatactattangtntcactcgtcgcctgagatctcctcatcgcttctacgagtcctacgaagtctagggaccaacgccgtccctaccctaactactctcgtcgggtctccgtagtttgacggacgtacgtctaacttacttacgtgtaccttagtttacttaaagtcgccgtacctacgttctcgggttcggtttcggcgggaacgtccgaacgtaacggttcgtacccgtccgttcgggttcaccggaacccgacggtcctccggacccccttgggttcccaacgtttccccg

SEQ ID NO: 356435 - DNA, 602 bp, Homo sapiens
  misc_feature: GZ8MTXP01A2U2F.22.36.D03.1.454.CMB.2.raw
  modified_base (400)..(400): a, c, t, g, unknown or other
  misc_feature (400)..(400): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtcctgacactctcctgtgcagcctctggattcacagtcagcagcaatgccatgagttggtccgccaggctccgaggggaaggggttgcgaggtgggtcgtcgggggattgggaagtgacgtggtgccacacaactacgcagacctccggtggacgggggcccncttcatcatctcagagacgacttaccgaaacacagtagaatcgtaggactaaattcgaacacgcctcgacggccgaccggaacggtaccgacggcccgtcttaaccttcgtacgttacggtacgaaaacgttcccgttcgtttacgtttttcggggcccgccgggtacccgtacgttaccggtcgggggccgtaacccgggg

SEQ ID NO: 356436 - DNA, 563 bp, Homo sapiens
  misc_feature: GZ8MTXP01EMV2E.22.36.D03.1.454.CMB.2.raw
  modified_base (217)..(217): a, c, t, g, unknown or other
  misc_feature (217)..(217): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgagggaaggggttgcagtgggtctcggggattggaagtgatggtgccacacactacgcagactccgtgagggccncttcatcatctccagagacgattaccgaaaacacagtgaatctgacaaatgtacagcctcagcgccgaggacacggccgtctacttctgtgacgaaacgacctctagtttttcggccgcggccgacctacgtggggccgaggccaacccgtggtcaccgtctcttcacgcctcaccacggcccagtcgtccttcccctggccgccctgcctccgacggacgccacccgtccgggacgacgccaccgacgcccggcccgtgggcctcgtcccgtggtaccaagggaacctacgttcccgacgttcgtatcgttccgttgacggcgggcgtggcgacggcgcgaagtg

SEQ ID NO: 356437 - DNA, 666 bp, Homo sapiens
  misc_feature: GZ8MTXP01AUVOZ.22.36.D03.1.454.CMB.2.raw
  modified_base (222)..(222): a, c, t, g, unknown or other
  misc_feature (222)..(222): n is a, c, g, or t
  modified_base (255)..(255): a, c, t, g, unknown or other
  misc_feature (255)..(255): n is a, c, g, or t
  modified_base (463)..(463): a, c, t, g, unknown or other
  misc_feature (463)..(463): n is a, c, g, or t
  modified_base (657)..(657): a, c, t, g, unknown or other
  misc_feature (657)..(657): n is a, c, g, or t
tcagacatacgcgtcacgaccggtgctcgatttagctgcgtcacgatctctcttggggttttggggggggtccctgacactctcctgtgcagcctctggattcacagtcagcagcaatgccatgagttgggtccgccaggctccgaggggaaggggttgcaggtgggtctcggggattggaagtgatggtgccacacactacgcagactccgtggagggccncttcatcatctccagagacgattaccgaaaacncagtgaatctgacaaatgtacacgcctcagcgccgaggaccacggccgtactacttctgtcgacgaaacgtcctcgtttagttttcggggccgcggccgtaccgtacggtggggacccgacgggccaacccgtggtccctaccgtctccttcacgtccctaccaacccgaacggggcccctacggttcccggttccctttccccccgngggtccccgtccccgttcggcccttacccggacgggtaccgacctacccgtaccggggagacgccaccgacggccccggcccgttcggggcttcgggtcccttacgggtaccaaacgggtaaccttaaccgttcccgaaaccgttccggttaagtcgttccggttggccggcggggctcgggcgaacggggccngaacgtaag

SEQ ID NO: 356438 - DNA, 526 bp, Homo sapiens
  misc_feature: GZ8MTXP01D8TWV.22.36.D03.1.454.CMB.2.raw
  modified_base (237)..(237): a, c, t, g, unknown or other
  misc_feature (237)..(237): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
  modified_base (372)..(372): a, c, t, g, unknown or other
  misc_feature (372)..(372): n is a, c, g, or t
  modified_base (389)..(390): a, c, t, g, unknown or other
  misc_feature (389)..(390): n is a, c, g, or t
  modified_base (516)..(516): a, c, t, g, unknown or other
  misc_feature (516)..(516): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtnactagttggttctttgactctgctctgtaccaaacacacccagaccaaacccccatcatcatttangtntcactcgtcgcctcgaggactctcncatcgcttcncagctcaagtctgcacncgcctccaacntcnctggctcgtagttgagnngtctacttattactgtctaagtttaccttaaatcgctcactcgtcgttggtttcggcggtaagcacggaagttcgaccgtccgttcggttcacggtcccaacgggtcctccggccccttcggtccnccgtttcccg

SEQ ID NO: 356439 - DNA, 517 bp, Homo sapiens
  misc_feature: GZ8MTXP01D02ZD.22.36.D03.1.454.CMB.2.raw
  modified_base (432)..(432): a, c, t, g, unknown or other
  misc_feature (432)..(432): n is a, c, g, or t
  modified_base (451)..(451): a, c, t, g, unknown or other
  misc_feature (451)..(451): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggaccaaaccccccaactcatcatttatgtgtcactcgtcgcctcagagtctcctcatcgcttctcagctcaagtctgcacacgcctaccctaacatctctggctccagtttgagacagtctacttattacgtgctagttactttaaatagcncctactctcgtgtttcggnggaagcacgaagttcgaccgtcttcgttcacgtcccaggcctcgccccttcggtccaacgttcccg

SEQ ID NO: 356440 - DNA, 672 bp, Homo sapiens
  misc_feature: GZ8MTXP01CIXDW.22.36.D03.1.454.CMB.2.raw
  modified_base (218)..(218): a, c, t, g, unknown or other
  misc_feature (218)..(218): n is a, c, g, or t
  modified_base (235)..(235): a, c, t, g, unknown or other
  misc_feature (235)..(235): n is a, c, g, or t
  modified_base (266)..(266): a, c, t, g, unknown or other
  misc_feature (266)..(266): n is a, c, g, or t
  modified_base (311)..(311): a, c, t, g, unknown or other
  misc_feature (311)..(311): n is a, c, g, or t
  modified_base (346)..(346): a, c, t, g, unknown or other
  misc_feature (346)..(346): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaacccaanagtgactagtttgggtcttttgactctgtcncctgtaccaacaacacccagccaaaccccccatcatcattatgtntcactcgtcgccctgagagtctctccatcgcttcncaacgctcaagtctggcaaccacggccctaccctaacactctcgtcgggcctccgtagtttcgagacgtacgttctaactattactggtcttaagttttaccttaaaagtttcggccgtaccctacgtttcccgttcgggtttcggggtttttccgggaccggggtacgggtaacccgtaacccgggttaaacgggttccgttaaccccggttcccgttccggggttacccgttaccgggcccccgtaaaacgggggtccccttcccccgggtcccccccggttccggttacccgttaaccccgttcccggtttttcccccccggg

SEQ ID NO: 356441 - DNA, 552 bp, Homo sapiens
  misc_feature: GZ8MTXP01DC08C.22.36.D03.1.454.CMB.2.raw
  modified_base (218)..(218): a, c, t, g, unknown or other
  misc_feature (218)..(218): n is a, c, g, or t
  modified_base (287)..(287): a, c, t, g, unknown or other
  misc_feature (287)..(287): n is a, c, g, or t
  modified_base (299)..(299): a, c, t, g, unknown or other
  misc_feature (299)..(299): n is a, c, g, or t
  modified_base (333)..(333): a, c, t, g, unknown or other
  misc_feature (333)..(333): n is a, c, g, or t
  modified_base (352)..(352): a, c, t, g, unknown or other
  misc_feature (352)..(352): n is a, c, g, or t
  modified_base (545)..(545): a, c, t, g, unknown or other
  misc_feature (545)..(545): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtctttgactctgtctctgtaccaacacaccacgcaacccccancatcattatgtntcactcgcggcctcaggatctcctcatcgcttcncagctcaagtctggcaacncggcctaccctaacatctctcgggctcctagttgaggacacgtctactttattacgtcgtcttacgttacctttaaagtacggtccgtacctacttcgttcgttcgggtttccgggcgggtaacggcaccggtaggccggtaccgtccgttcggttcacggtcccaacgggtcctccgccccgttcgggtccncttcccg

SEQ ID NO: 356442 - DNA, 560 bp, Homo sapiens
  misc_feature: GZ8MTXP01E0GTZ.22.36.D03.1.454.CMB.2.raw
  modified_base (217)..(217): a, c, t, g, unknown or other
  misc_feature (217)..(217): n is a, c, g, or t
  modified_base (249)..(249): a, c, t, g, unknown or other
  misc_feature (249)..(249): n is a, c, g, or t
  modified_base (555)..(555): a, c, t, g, unknown or other
  misc_feature (555)..(555): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattccgaaaacncagtgaatctgacaaatgtacagcctcagcgccgaggacacggccgtctacttctgtgacgaaagacctctagttttcggccgcggccgacctacgtggggccagggccaaccctggtcaccgtctcttcacgcctccaccgaacgggcccactccggtccttcccccgtggcccgccccttggcctcccgaggacgccaccctccgggagacgccacgacggcccgcccgtggggctcggccgtggtccaagggctacttccgacgttcgtactgttccgttgacggcgggctggcaaggcgcgngtaag

SEQ ID NO: 356443 - DNA, 657 bp, Homo sapiens
  misc_feature: GZ8MTXP01B9V1N.22.36.D03.1.454.CMB.2.raw
  modified_base (271)..(271): a, c, t, g, unknown or other
  misc_feature (271)..(271): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctcctgtgcagcctctggattcacngtcagcagcaatgccatggagttcggtcccgccgaggcctccgaagggggaaggggttgcgtaggtgggtcgtcgggggattggaagtgagtggtgcccgacacgaactacgcacgaccgtccggtggacggggcccgcttcacgtcactctccagtacgaacgtacgttaaccgaaaacacgagtagaactctacgggaactaaagtacgtaacacgtcctacgacgaccggaccggaacgggaccgtaaccgggcccgttaaccttaaccgtttccgtcggttacggtaacggtaaacgttacccgtttcgtttacggtttttccggggcccggtccgggtaccccggtacgttaccgggttcgggggaacccgtaacccgggg

SEQ ID NO: 356444 - DNA, 749 bp, Homo sapiens
  misc_feature: GZ8MTXP01EEA4F.22.36.D03.1.454.CMB.2.raw
  modified_base (404)..(404): a, c, t, g, unknown or other
  misc_feature (404)..(404): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaaccaacagtgactagttgggttctttgactctgtctccgtgtaccaaacaacacccacgacccaaaccccccatcatctattatgtgtcactcgtccgcctcgagtacgtctcctctatcgtcttctacagcctcctaaagtcgtacgaccaaccgccgtaccctaccctaaacnctcgtccgtcgggtaccttaccgtaggtttacggaacggtaccgtaacgttaccttaaactttaacgtttaccttacggttacccttaaacgggttttttaaccctttaaaaacgttccggggtacccgttacccttaaaccctttccggtttccgggttttacggggtttttccccggggaacgggggtaaaccgggtacccgttaaacccggggtaaacgggtttcccggaaccccggtttccccggttaccggggttaccacccgggttaacccccggaacgggttcccctcccgggttcccccccgttcggggtttaaccccgttaaccgtttcccccggg

SEQ ID NO: 356445 - DNA, 630 bp, Homo sapiens
  misc_feature: GZ8MTXP01B24MP.22.36.D03.1.454.CMB.2.raw
  modified_base (301)..(301): a, c, t, g, unknown or other
  misc_feature (301)..(301): n is a, c, g, or t
  modified_base (358)..(358): a, c, t, g, unknown or other
  misc_feature (358)..(358): n is a, c, g, or t
  modified_base (394)..(394): a, c, t, g, unknown or other
  misc_feature (394)..(394): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttggtccncaggctccgagggaaggggttgcgagtgggtcgtgggggattgggaagtgatgggtnccacacaactacgcagacctccggtgacgggggccncttcatcactctcagacgaacgacttaccgaaaacacacgtagaagtctaggacaaattacgtaacacgccctacgacgaccggcccggtaacggaccgaaccgggtcccgtccgtaaccgtttccgtcggttacgtaaccggaaacgttaccccgttcgtttaacgttttttcggggccccggtcccggggtacccgtacggttaacccggttccgggggcccgtaacccggggg

SEQ ID NO: 356446 - DNA, 564 bp, Homo sapiens
  misc_feature: GZ8MTXP01AL9O2.22.36.D03.1.454.CMB.2.raw
  modified_base (556)..(556): a, c, t, g, unknown or other
  misc_feature (556)..(556): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctgtaccaacaacaccagccaaacccccactcatcatttatggtgtcactcgtcggccctcaggacgtctccctcatcgtcttctaccaggtcctccaaagtctcgggaccaacgaccggcccctaccctaaaccactcctccgtcgggtcctcccgtagtttcgaggacgtagtcttaacttattacgtgtctagtttacctttaaaagttcggctcctactcttcggtggtttcggcgaaggcacgagttcgtaccgtcgttcggttcacgcccaggcctcgccccgttcggtcnccgttccg

SEQ ID NO: 356447 - DNA, 572 bp, Homo sapiens
  misc_feature: GZ8MTXP01AWPDZ.22.36.D03.1.454.CMB.2.raw
  modified_base (220)..(220): a, c, t, g, unknown or other
  misc_feature (220)..(220): n is a, c, g, or t
  modified_base (253)..(253): a, c, t, g, unknown or other
  misc_feature (253)..(253): n is a, c, g, or t
  modified_base (450)..(450): a, c, t, g, unknown or other
  misc_feature (450)..(450): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccgagggaaggggttgcagtgggtctcggggattggaagtgatggtgccacacactacgcagactccgtggaggggccncttcatcatctccagagacgattaccgaaaacncagtgaatctgacaaatgtacagcctcagcgccgaggacacggccgtctacttctgtgacgaaagtacctcttagttttcgggccgcggccgtacctacgtcggggccagggccaacccgtggtccaccgtctcttcacgcctccaccgacgggcccagtccggtcctccccgtggcccgccctgcctccgaggacncacccgtcgggagacgcacgacgccggcccgtgggcctcgcctcggtcaacgggaactccgttccgacgcgtagtcgttcgttgggacggtcggggcgtcgggacgacgggcgtccgaagtg

SEQ ID NO: 356448 - DNA, 583 bp, Homo sapiens
  misc_feature: GZ8MTXP01EUW1O.22.36.D03.1.454.CMB.2.raw
  modified_base (262)..(262): a, c, t, g, unknown or other
  misc_feature (262)..(262): n is a, c, g, or t
  modified_base (362)..(362): a, c, t, g, unknown or other
  misc_feature (362)..(362): n is a, c, g, or t
  modified_base (394)..(394): a, c, t, g, unknown or other
  misc_feature (394)..(394): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtcctgacactctcctgtgcagcctntggattcacagtcagcagcaatgccatgagttcggccgcaggctcgagggaaggggttgcgaggtgggtcgtcgggggattgggaagtgagtggtgccanacaactacgcagactccggtggacgggggccncttcatcatctcagagaacgacttaccgaaacacgagtagaatcgaggacaaatgtaacagccctcgacgccgaccggaacggaccgaccggtccgtctacgttctaggttcgaccgtaaagttacccgttcgtttacggttttcgggccggtcggtcccgtacgttacggtcggggccgtaaccgggg

SEQ ID NO: 356449 - DNA, 681 bp, Homo sapiens
  misc_feature: GZ8MTXP01D58YI.22.36.D03.1.454.CMB.2.raw
  modified_base (315)..(315): a, c, t, g, unknown or other
  misc_feature (315)..(315): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtcgggaaccaacagtgactagttgggttctttgactctgtctctagtaccaacaacacccacgaccaacccccaactcatctatttatgtntcactcgtccggccctcgaggagtctcctcactcgtcttctacacgtctaccgaaagtctacggaccaacgaccggtccctacccctaacacttctcgtcgggcttaccgtaggtttcgaacgggtacgtagttaccttaacgtttacttacgtacgtacttaacgtttaccgtttaaaacgttacggtcccgtaccgtacttccgttcgggtttcgggttttccggggcgggtaacggtccgttaacccggtaaacgggttccgtaaccccggttcccggttaccggttccgaaccggaacccccggtaacgggtcccgttccccgggtccccccgttaccgggtcccttaacccgtttcccccg

SEQ ID NO: 356450 - DNA, 573 bp, Homo sapiens
  misc_feature: GZ8MTXP01EN763.22.36.D03.1.454.CMB.2.raw
  modified_base (274)..(274): a, c, t, g, unknown or other
  misc_feature (274)..(274): n is a, c, g, or t
  modified_base (301)..(301): a, c, t, g, unknown or other
  misc_feature (301)..(301): n is a, c, g, or t
  modified_base (349)..(349): a, c, t, g, unknown or other
  misc_feature (349)..(349): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggcttaattttaaaaaggtgtcaagtgtgcggtgaaggtatggagtcgtgggggagcttggtacgaggccgggggggtccctgacactctctgtgcagcctctggatcanagtcagcagcaatgcatgagtcggccncagctcgagggaggtgcgaggtggtcgtgggattggaagtgatgggtnccaacgacaactacgcagaccgtcgtagggacggggctcttcactcatcaccgagagaacacttaaccgaaaacacagacgtaatctaggactaaatcgtaacacgccacgagaccgccggaacgaccgaccggtccgtaacttaccgttcgtcgttacgaacgtaaacgttcttcgtttaggtttcgggccgcggccgtacgttacgtcggggccgaaccggg

SEQ ID NO: 356451 - DNA, 572 bp, Homo sapiens
  misc_feature: GZ8MTXP01C0B06.22.36.D03.1.454.CMB.2.raw
  modified_base (218)..(218): a, c, t, g, unknown or other
  misc_feature (218)..(218): n is a, c, g, or t
  modified_base (254)..(254): a, c, t, g, unknown or other
  misc_feature (254)..(254): n is a, c, g, or t
  modified_base (363)..(363): a, c, t, g, unknown or other
  misc_feature (363)..(363): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtctttgactntgtctctggtaccaacaacacccaggcaaaccccccatcatcatttatgtgtcactcgtcggccctcaggagtctcctcatcgcttctcaggctccaagtctggcaacncgccctaccctaacactctctcgggctcctagtttgaggacgtacgtcttacttattacgtgtctacgtttacctttaaagttaggccgacctactcgttcggttggtttcgggcggaacggcgttacggaaacgttggtaacccgtccgttcggttcacggccccaagggtccgtccggtcccccgttcgggtcccgaactttccccg

SEQ ID NO: 356452 - DNA, 641 bp, Homo sapiens
  misc_feature: GZ8MTXP01AWZU9.22.36.D03.1.454.CMB.2.raw
  modified_base (236)..(236): a, c, t, g, unknown or other
  misc_feature (236)..(236): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtnactattgggtctttgactctgtctctgtaaccaacaacacccagaccaaccccccatcatcattangtntcactcgtcgcctnaggntctcctcatcgcttcacaggctcaagtctggacaacgccggccctaccctaacattcctcgtcgggtcctacccgtaggtttcgacggacgtagttacctaactttacttacggtcgtacgttaacgtttaccctttaaagtacgggtccctacccgtacttccgttcggttcgggttttccgggcgggtaacggtcccgttaaacccgggtaacggttaccgtaaccccggttccgttaccgggttcccaccggtaaccccgaacgggtcccgtcccggtccccccggttcgggttaacccttaacccgtttccccg

SEQ ID NO: 356453 - DNA, 515 bp, Homo sapiens
  misc_feature: GZ8MTXP01EYP0Q.22.36.D03.1.454.CMB.2.raw
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
  modified_base (320)..(320): a, c, t, g, unknown or other
  misc_feature (320)..(320): n is a, c, g, or t
  modified_base (358)..(358): a, c, t, g, unknown or other
  misc_feature (358)..(358): n is a, c, g, or t
  modified_base (372)..(372): a, c, t, g, unknown or other
  misc_feature (372)..(372): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctggtaccaacaacacccagaccaaaccccccatcatcatttangtntcactcgtcgcctnagagtctcctcatcgctctcagctccaagtctgcaacncgcctccaacatcncgtggctccagttgagacagtctacttattacgtgtctagttacctttaaatcggctccacttcgtcgttggtttcggcggaagtcacgagttcgaccgtccttcggttcacgccaggcctccgcccttcgtccttcgtcccg

SEQ ID NO: 356454 - DNA, 657 bp, Homo sapiens
  misc_feature: GZ8MTXP01AMGFZ.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttggctgaagtggcttttgcttgtggctaattttaaaaggtgtcaagtgtgcggtgaaggtattggagtcgtgggggaggcttggtacgaggccggggggtccctgacactctcctgtgcagcctctggattcacagtcagcagcaatgccatgagttcggccgcaggctccgaggggaagggttgcgaggtgggtcgtcgggggattggaagtgagtggtcgaccacgacaacgttaacgcaagacctcccggtggacgggggccctcttacacgtcactctcgagagacgtaacttaaccgaaaacacgaagtacgaactacgtacggaactaaacgtacgtaacacgcctacgacggaccgccggtaacggaccgaccgggcccgttaaccgttaacctttccgtacgttacggtaaaccggtaaacgttaccccgttcgtttaaccggtttttcggggccccggtccgggtaccccggtaccgttaccgggttccggggaaccggtaacccgggg

SEQ ID NO: 356455 - DNA, 617 bp, Homo sapiens
  misc_feature: GZ8MTXP01A2K2U.22.36.D03.1.454.CMB.2.raw
  modified_base (302)..(302): a, c, t, g, unknown or other
  misc_feature (302)..(302): n is a, c, g, or t
  modified_base (322)..(322): a, c, t, g, unknown or other
  misc_feature (322)..(322): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgagggccggggggtccctgacactctcctgtgcagcctctggattcacagtcagcagcaatgccatgagttggccncaggctcgaggggagggttncgaggtgggtcgtgggggattggaagtgagtggtgccacacaactacgcagtaccgtccggtggacgggggccctcttcactcactcctacgagacgacgacttaaccggaaacacgaagtagaatacgtacgaactaaagtacgtaacacgccctcgaacggccgaccggaacggaccgaccggtcccgtaactaccgttcgtacgttacgaacgtaaacgttacccgttgtttacggttttcggggacccgtccgggaccggtaccgttaccgggtcggggccggtaaccggg

SEQ ID NO: 356456 - DNA, 645 bp, Homo sapiens
  misc_feature: GZ8MTXP01BJJO6.22.36.D03.1.454.CMB.2.raw
  modified_base (219)..(219): a, c, t, g, unknown or other
  misc_feature (219)..(219): n is a, c, g, or t
  modified_base (314)..(314): a, c, t, g, unknown or other
  misc_feature (314)..(314): n is a, c, g, or t
  modified_base (329)..(329): a, c, t, g, unknown or other
  misc_feature (329)..(329): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaaccaacagtgactagttgggtctttgactctgtctctgtaccaacaaccacccacggaccaaccccccatcactctatttatgtntcactcgtccgcctnaggtacgtctcctcatccgtcttctcacggtcctacctaagtcctacgacctaaccgaccggtccctacccctaactacttcgtcgtcgggtaccttccgttaaggtttcgacggtacgtacgttaccttacgtttaacttacgtcggttaccttaagtttaaccctttaaagtccggtctacctacgttccgttcgggttcggtttccggcggtaacggtaccaccggtaaaggttccgtaacccggtccgttacggccacggtaaccccgaggtcccgttcccgcccccgttcggtccttaacccgtttcccgg

SEQ ID NO: 356457 - DNA, 809 bp, Homo sapiens
  misc_feature: GZ8MTXP01EZRQ7.22.36.D03.1.454.CMB.2.raw
  modified_base (206)..(206): a, c, t, g, unknown or other
  misc_feature (206)..(206): n is a, c, g, or t
tcagacatacgcgtcacgaccggtgctcgatttagctgcgtcacgatctctcttggggagctctgagagaggagcccagccctgggattttcaggtgttttcatttggcgatcaggactgaacagagagaactcaccatggagtttgggctgaagtggcttttgcttgtggctattttaaaaggtgtcaagtgtgcggtgaaggtnttggagtcgtgggggagtcgttggtacgaggccggggggtccctgacactctcctgtgcagcctgtggattcacagtcagcagcaatcgaccagtggtaggtttcgggtacccgccgaagggtcctacccggaaggggggtaagggggtttcacggtagggttcgggggttcggtacggggggtatttagggggaaaggtggtaacgttcggggttaacggaccccaacgaaccgtaacccgttaacggaccgtaaccgggtaaccgttccccggggttaggggaaccggggggtcccggttcctttaccgaacgtaccgtaactttacccgtacccgtaaaggaaccggtaaaccggttaaccgttaaacccgaaaaaaccgtaacccggtaaaggggttaacggtaaacttaccgttacggtaaaccctaaaagttacgttaaccgaaacggccctaccgaaccggaccggacccggaacgggacccgttaacccgggtcccgttaccgttaccgttcggttacggttcgaaccggtaaaacgtcccgttaacgtttacggttttccggggaccggtcccgggttaaccggttaacccggg

SEQ ID NO: 356458 - DNA, 770 bp, Homo sapiens
  misc_feature: GZ8MTXP01CTC84.22.36.D03.1.454.CMB.2.raw
  modified_base (269)..(269): a, c, t, g, unknown or other
  misc_feature (269)..(269): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtggcggtgaaggtattggagtcgtgggggaggcttggtacgaggcccgggggggtcctgacactcctcgtgtcgcncgtcctcgtggtattcactagtcagcagacaagtcgacctagtcggtacggtttccggggtccccgaccggaacggtccgtaccggaagggggttaacgggggttgacggtagggttcggggtcggtacgggggtaacgttaggggtaaaggtggtacggttgggacccgaacccaaccgtaaaccgtaacccgtaaccgacgtaaccggtaccggttccgggacgggggaccggggtccctactttaccgattaccgtacttaccgtacgaacggaacgaaccgttaaccgtaaaacccgaaaacaccgtaaggggtaacccgtaataccgtagaaaaccgtaagtacggtaacaccgtccctagaccggcccggaacggaacgtaaccggaccggttccgttcttaacccgttgttacgggttacggaaaccgttaaaccggtccttttcgttttacgggttcccggggacccggtaaccggttaacccgttaaccggg

SEQ ID NO: 356459 - DNA, 665 bp, Homo sapiens
  misc_feature: GZ8MTXP01AT0N6.22.36.D03.1.454.CMB.2.raw
  modified_base (268)..(268): a, c, t, g, unknown or other
  misc_feature (268)..(268): n is a, c, g, or t
  modified_base (313)..(313): a, c, t, g, unknown or other
  misc_feature (313)..(313): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttggtacgaggcccgggggggtccctgacactctcctgttcncgcctctggattcacagtcagcagcaatgccatgagttcgggccncaggctccgaggggaaggggttgcgaggtgggtcgtcgggggtatttcgggaaggtggagtgggtcgacctaacgaacaccgtacgacacgtaccgtcccggtagggacgggggcccgcgttacattcatcctaccaggacgaaccgacgttaacccgaaaacgaccgaagtagggaaacttcgtacgacctaaattcggaactacgaccctcgacggcccggacccggagggaaccgtaacccggcccggttaccttaccgttcgtcgttccgaccggttaaaacgtcccgttacgtttaagtttttcccggggcccggttacccgggcccggttaacgttaacccggggg

SEQ ID NO: 356460 - DNA, 707 bp, Homo sapiens
  misc_feature: GZ8MTXP01EPQPB.22.36.D03.1.454.CMB.2.raw
  modified_base (233)..(233): a, c, t, g, unknown or other
  misc_feature (233)..(233): n is a, c, g, or t
  modified_base (316)..(316): a, c, t, g, unknown or other
  misc_feature (316)..(316): n is a, c, g, or t
  modified_base (330)..(330): a, c, t, g, unknown or other
  misc_feature (330)..(330): n is a, c, g, or t
  modified_base (400)..(400): a, c, t, g, unknown or other
  misc_feature (400)..(400): n is a, c, g, or t
tcagacatacgcgtcacgaccggtgctcgatttagctgcgtcacgatctctcttgaggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcatcagctatttcctgcactgggaaccaanagtgactagttgggtcttttgactctgtctcctaggtaaccaacaacacccacgacccaaaccccccatcatcatttatggtntcactcgtcgcctnagctcctctcatcgcttctcaacgtctaccgagttcgaggaccaacgaccggtcccctaccctaaacctntccgtccgtacgggtccttaccgttaggtttacggaacgggtaacctacggtttacctttaaccgtttaatttaacccgttacggtacctttaaacggtttttaaccccttttaaaaggtccgggtcccttaaacccgtaccgtttcccgtttacggggtttcgggttttcccggggaacggtaaccgggttcctaaaccgggttaaacgtcccggtaaccccggttccgttccggggttaccaacccgggtaccccgaaaggggtccccttcccggttcccccgtccgggttaacccttaaccccg

SEQ ID NO: 356461 - DNA, 615 bp, Homo sapiens
  misc_feature: GZ8MTXP01BTHX0.22.36.D03.1.454.CMB.2.raw
  modified_base (216)..(216): a, c, t, g, unknown or other
  misc_feature (216)..(216): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattaccgaaaacacagtgaatctgcaaatgtacagcctcagcgccgaggacacggccgtctacttctgtgcgaaagacctctatttttgggccgcggccgacctacgtggggccagggcaacccgtggtcaccgtctcttcacgcctccaccacgggcccatcggtccttcccccgtggcccgccctcgcctccgaggcgccacccgtccgggacgacgccaccgacggcccggcccgtcggggcctcggtccccgtgggttaccgaaacggggtaacccttaaccgtttcccgaaccggttccggttaaacgtcggttcccgttggacgggcccgggggtcgttcggggacccgaacggggccgaaccgaagttaagg

SEQ ID NO: 356462 - DNA, 608 bp, Homo sapiens
  misc_feature: GZ8MTXP01DBLMG.22.36.D03.1.454.CMB.2.raw
  modified_base (315)..(315): a, c, t, g, unknown or other
  misc_feature (315)..(315): n is a, c, g, or t
  modified_base (328)..(328): a, c, t, g, unknown or other
  misc_feature (328)..(328): n is a, c, g, or t
  modified_base (331)..(331): a, c, t, g, unknown or other
  misc_feature (331)..(331): n is a, c, g, or t
  modified_base (519)..(519): a, c, t, g, unknown or other
  misc_feature (519)..(519): n is a, c, g, or t
  modified_base (562)..(562): a, c, t, g, unknown or other
  misc_feature (562)..(562): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttcctgcacgtgggaaccaacgtgtgactagttgggtctttgactctgtctcctggtaaccaacaaccacccacgaccaaaccccccatcatcatttatgtntcactcgcgcctnagntctcctcatcgtcttctacacggtcctacgaaacgtcgtacggaccaaccgaccggtacccctaccctaaacctactcctcgtcgggtccttaccgtagtttgaacggtacgacgttacttaacttacttacgtgtactagtttaccttaaagttcgcgtacctacttcgttacgttgggtttccggnggtaacggcgttaacggtacgttcgtaccgtccgttcggttcncgaacccacggccgttaccgccccgttcggtccttaaccgttcccg

SEQ ID NO: 356463 - DNA, 635 bp, Homo sapiens
  misc_feature: GZ8MTXP01DLFU9.22.36.D03.1.454.CMB.2.raw
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
tcagacatacgcgtcacgaccggtgctcgatttagctgcgtcacgatctctcttggggttttggggggggtccctgacactctcctgtgcagcctctggattcacagtcagcagcaatgccatgagttgggtccgccaggctccgagggaaggggttgcaggtgggtctcggggattggaagtgatggtgccacacactacgcagactccgtggagggccncttcatcatctccagagacgattaccgaaaacncagtgaatctgacaaatgtacagcctcagcgccgaggacacggccgtctacttctgtgacgaaagacctctagtttttgggccgcggccgacctacgtggggcaggcaaccctggtcaccgtctcttcacgcctcaccaacgggcccagtccggtccttccccctggccgcccctcgcctccgacggacgccacccgtccggagacgccaacgacggcccggcccgtcggggcctcggtcccgtgggttacccgaaacgggtaaccctttaacccgttaccccgtaaccgggttccgttaacgttcggttcccgttcgggaacgggtcccgggggtccgttcgggggaccgtaaacggggcccgtaaccgaacgttaaggg

SEQ ID NO: 356464 - DNA, 668 bp, Homo sapiens
  misc_feature: GZ8MTXP01CTK1P.22.36.D03.1.454.CMB.2.raw
tcagacatacgcgtcacgaccggtgctcgatttagctgcgtcacgatctctcttggggagctctgagagaggagcccagccctgggatttttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggtcgttgggtacgaggcccgggggggtccctggacactctcctgtgcagcctctggattcacagtcagcagcaatgaccctagtggtacggtttcgggggtccccgccgagggcctccggagggggtaaggggttcgacgtaggtcggggtctcgggggtattgggaagtgagtggtacgcccaacgacactacgacaggaccgtcggtgggacggggtccgtcttacagtccatctccaggacgaacgacttaaccgaaaacaccgaaggtacgaattccgtagacctaaaagtcgtaacacgcccgtcacggccgcccggaacggaaccgaccgggtcccgttacgttaaccttcgttacggttcgttaacccgggtaaaccgtcccgttaacgttttaacggttttccgggggacccgtccgggttcccggttaacccggg

SEQ ID NO: 356465 - DNA, 601 bp, Homo sapiens
  misc_feature: GZ8MTXP01EQBKQ.22.36.D03.1.454.CMB.2.raw
  modified_base (246)..(246): a, c, t, g, unknown or other
  misc_feature (246)..(246): n is a, c, g, or t
  modified_base (368)..(368): a, c, t, g, unknown or other
  misc_feature (368)..(368): n is a, c, g, or t
  modified_base (386)..(386): a, c, t, g, unknown or other
  misc_feature (386)..(386): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaggtattggagtcgtgggggagcgttggtacgaggcggggggtccctgacnctctcctgtgcagcctctggattcacagtcagcagcaatgccatgagttgggtccgccaggcctccgagggaaggggtttgcaggtgggtcgtcgggggattgggaagtgatgggtgcccanaccaaactacgcaagacnccgtggaggggccgctcatcatctcagagacgattaccgaaaacacaagtagaatctagggctaaatcgtacagccctcgaacgccgaccggtaggaccgaacccgggtccgtccgttaaccttcgtacggttcgaacgtaaacgacccgtttcgttacgtttttcggggcccgtccgggcccggtaccgttacggtccggggccgtaaccgggg

SEQ ID NO: 356466 - DNA, 713 bp, Homo sapiens
  misc_feature: GZ8MTXP01D76G8.22.36.D03.1.454.CMB.2.raw
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (340)..(340): a, c, t, g, unknown or other
  misc_feature (340)..(340): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacagtgactagttgggtctttgactctgtctctgtaccaacaacacccagaccaaacccccatcatcattangtntcactcgtcgcctgagactctctcatcgcttcncacgtctacaagtctcggaccaacgacggccctaccctaactcttccgtactcgggtccttaccgtaggttttacggaacgggtaaccgttaacgttaccttaactttaacgtttaccgttacgtacgtttaaaccgttttaaccgttttaaaagttccggtcccgtacccttaccgtttccgtttccggggtttcgggtttttcccggggaccggggtaacggtccccgttaaaccggggtaacggttacccgggtaaccccgttccccggttccgggttacccgaaccccgggttccccggaaaaccgggggtcccttacccccggggtacccccccgttccgggttaaccccgttcccgttttcccccgg

SEQ ID NO: 356467 - DNA, 571 bp, Homo sapiens
  misc_feature: GZ8MTXP01D0TW7.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtcctgacactctcctgtgcagcctctggattcacagtcagcagcaatgccatgagtggccgcaggctcgagggaagggtgcgagtgggtcgtcggggattgggaaagtgatggtcgacccaagaacactaaacggccaaggtaccgtccggtgggacgggggccgtccttacatcactctccaagacgaacgacttaaccgaaaacacgaaggtagtaaatcctagaacaaagtcgtaacaacgcctacaagccgaccgaacggacacggccgttcgtacttcttgttgacgaataccgtcttagtttcggccgtaacggcgtaaccg

SEQ ID NO: 356468 - DNA, 631 bp, Homo sapiens
  misc_feature: GZ8MTXP01CHR0C.22.36.D03.1.454.CMB.2.raw
  modified_base (360)..(360): a, c, t, g, unknown or other
  misc_feature (360)..(360): n is a, c, g, or t
  modified_base (374)..(374): a, c, t, g, unknown or other
  misc_feature (374)..(374): n is a, c, g, or t
  modified_base (397)..(397): a, c, t, g, unknown or other
  misc_feature (397)..(397): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttgggccgccaggctccgaggggaaggggttgcgagggtggtcgtcggggattggaagtgatgggtnccacacaactacgnacgacgtccgtggacggggcccncttcatcatctccagacgacgacttaaccgaaacacagtacgaatactaggacaaagtcgtaacacgtccctacgacgccggaccggaacgggaccgtaccgggcccgttccttaaccgtttccgttacgggttacgaaccgggtaaacgttacccgttcgttttaacggtttttccggggacccggtccgggacccggtaccttaccggggttccggggcccggtaaccgggg

SEQ ID NO: 356469 - DNA, 657 bp, Homo sapiens
  misc_feature: GZ8MTXP01BPSD1.22.36.D03.1.454.CMB.2.raw
  modified_base (402)..(402): a, c, t, g, unknown or other
  misc_feature (402)..(402): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttggtccgccaggctccgaggggaaggggttgcgaggtggggtcgtcgggggattggaaggtgagtggtcgccacacaacctacgcagaccgtccggtgacgggggccncttacatcactctccagacgacgtactaccgaaacacagtacgaaatccgttagggactaaagtactaacgacgcccgtacgacggaccggacccggtaacggaccgaaccgggtcccgttaaccgttaaccgttcgttcggttacggtaaccggaaaaccgttaccgttccgtttaacggtttttccggggaccccgggtccgggtaccccgggtacggttacccgggtccgggggttaaccgtaacccggggg

SEQ ID NO: 356470 - DNA, 587 bp, Homo sapiens
  misc_feature: GZ8MTXP01AXOJ0.22.36.D03.1.454.CMB.2.raw
  modified_base (219)..(219): a, c, t, g, unknown or other
  misc_feature (219)..(219): n is a, c, g, or t
  modified_base (310)..(310): a, c, t, g, unknown or other
  misc_feature (310)..(310): n is a, c, g, or t
  modified_base (441)..(441): a, c, t, g, unknown or other
  misc_feature (441)..(441): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcactgggaaccaacagtgactattgggttcttttgactctgtctcctggtaccaacaacaccacggaccaaacccccactcatcatttanggtgtcactcgtcggcctcaggacgtctcctcatcgcttctcacggctcgaagtctggcaacacggtccctaccctaacactctcgcgggtctcccagtttgacggtacgagtctatttacgttactcgtnttacgtttaccttaaagttcggctcctaacgttcgtcgttcgggttttcgggcggtaacggtccacggtaagttcggtacccgtcgttccggttcgaccgtcccgaagggtcctcggcccccgttcggtccttaaccgtttccccg

SEQ ID NO: 356471 - DNA, 636 bp, Homo sapiens
  misc_feature: GZ8MTXP01DFBJQ.22.36.D03.1.454.CMB.2.raw
  modified_base (426)..(426): a, c, t, g, unknown or other
  misc_feature (426)..(426): n is a, c, g, or t
  modified_base (437)..(437): a, c, t, g, unknown or other
  misc_feature (437)..(437): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggcttaattttaaaaggtgtcaagtgtgcggtgaaggtattggagtcgtgggggagcgttggtacgaggccggggggtccctgacactctcctgtgcagcctctggattcacagtcagcagcaatcgccagtggaggtttcgggtcccgcgaggccgtccggaagggggtaagggggttgacgtaggttggggtcgtcgggggtatttgggaaagtgtaagtgggtacgaccaacacactacgcacgacgtccggnggacggggccncttcatcatctaccgagacgaacgaacgttaaccgaaaacacgaggtacgaattctacgactaaatcgtaacacgcctcgacgccgaccggaacggaccgaccgggtcccgttcttaccgttcgttacggttacaaccgtaaacgtaccgtttcgtttacgggttttcgggacccggtccggttaacccgtaacccggg

SEQ ID NO: 356472 - DNA, 628 bp, Homo sapiens
  misc_feature: GZ8MTXP01DS3JG.22.36.D03.1.454.CMB.2.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (310)..(310): a, c, t, g, unknown or other
  misc_feature (310)..(310): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaanagtgactattgggtctttgactctgtctcctggtaccaacaacacccaggaccaaaccccccaatcatcattatggtntcactcgtcggccttcaggatctcctcatcgcttctcaggctcaagtctggacctaacacggtccctaccctaaccactctctcgggctccgtagtttgacggacgtacgtctaactttattacttcggtacttacgtttacccgtttaaatttacggcgtacctaacttcgttcggttcgggttttccgggcgggtaacggtcgaaacccggtaaacggttcggtaaaccccgttccgttccgggttcgaccggtaaccccgaaaacggggtccctcccggtccccccgttcgggttaacccgttccctttccccgg

SEQ ID NO: 356473 - DNA, 560 bp, Homo sapiens
  misc_feature: GZ8MTXP01C6KG5.22.36.D03.1.454.CMB.2.raw
  modified_base (500)..(500): a, c, t, g, unknown or other
  misc_feature (500)..(500): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttgggccgccaggctccgagggggaaggggttgcgaggttgggtcgtcgggggattgggaagtgatggtgccacacaacgtacgcgagacctccggtggacggggcccgcttcactcactctaccagacgacgacttaccgaaaacacagtagaatctaggacaaatgtacacgcctcacgcgccgagacacggccgtctcttctgngacgaacgccgttcttacgttttcgggccgtcggccgacgttacgtcgggccgtaacggg

SEQ ID NO: 356474 - DNA, 527 bp, Homo sapiens
  misc_feature: GZ8MTXP01A5Y0D.22.36.D03.1.454.CMB.2.raw
  modified_base (218)..(218): a, c, t, g, unknown or other
  misc_feature (218)..(218): n is a, c, g, or t
  modified_base (424)..(424): a, c, t, g, unknown or other
  misc_feature (424)..(424): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattaccgaaaacacagtgaatctgcaaatgtacagcctcagcgccgaggacacggccgtctacttctgtgcgaaagacctctatttttgggccgcggccgacctacgtggggccagggcaaccctggtcaccgtctctcacgcctccaccacgggcccatcggtctcccctgccgcctgctcagcncacctcggagcgcacacgcggcccgtgggcctcgcctggtccaagggcctacttccgacgcgtagtgttcgttggacggcgggctcggacagggcgcgaagtg

SEQ ID NO: 356475 - DNA, 656 bp, Homo sapiens
  misc_feature: GZ8MTXP01D4W48.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctctgtaccaacaacacccagaccaaaccccccatcatctattatgtgtcactcgtcggccctcaggagtctcctcatcgcttctcaggctccaaagtctcggaccaaccgacggcccctaccctaaaccatcctcgtcgggctacccgtagtttgacggacgacgttcttaacttattacgtgtcttaacgtttacctttaaaattcggcctcctaaccgttcgttccggtttcggggttttccgggccggggttaacggaccgttaacccgggtaaacggttccggtaaccccggttcccgttaccggggttcccaacccgggtaacccccgaaacgggtccccgttacccggccccccccgtttacgggttaaccccttcccgttttcccccgg

SEQ ID NO: 356476 - DNA, 549 bp, Homo sapiens
  misc_feature: GZ8MTXP01DTG9E.22.36.D03.1.454.CMB.2.raw
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
  modified_base (541)..(541): a, c, t, g, unknown or other
  misc_feature (541)..(541): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctattcctgcactgggaccaacagtgactattgggtctttgactctgtctctggtaccaaacaacacccaggaccaaaccccccaatcatcatttatgtgtcactcgcggcctcaggagtctctcatcgcttcncagctcaagtctgcaacncgcctacctaacatctctggctcctagtttgaggacgtagtctacttacttacgtcgtcttaagtttacctttaaagtacggtcgtcctacttcgttcggttggttttccgggcggaacggtcacggtagttcgtaccgtcttcggttcacgtcccaaggcctcgccccgttcggtccncgttcccg

SEQ ID NO: 356477 - DNA, 649 bp, Homo sapiens
  misc_feature: GZ8MTXP01DN4T2.22.36.D03.1.454.CMB.2.raw
  modified_base (331)..(331): a, c, t, g, unknown or other
  misc_feature (331)..(331): n is a, c, g, or t
  modified_base (338)..(338): a, c, t, g, unknown or other
  misc_feature (338)..(338): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctattcctgcactgggaccaacagtgactagttgggtctttgactctgtctctagtaccaaacacacccacgacccaaacccccatcatctatttagtgtacgtcactcgtcggcctgagngtctccnctactcgtcttctacagtctaccagtcctcggacaacgaccgtccctacccctaactctcgtcgtcggtcctaccgtagtttcggaacggtacgtaacgttacttaatttacttacgtcggtactttaacggtttaacccttttaaagttccggtcctaccttaacgtttcgtttccgggtttgggttttccgggcggggtaacgaccgttaaccgggtaaacgttccggtaccggttcccgttaccggttcgaacccgccccgtaaggtccctcccggtcccccgttcggttcccttaaccgtttccccg

SEQ ID NO: 356478 - DNA, 672 bp, Homo sapiens
  misc_feature: GZ8MTXP01CL931.22.36.D03.1.454.CMB.2.raw
  modified_base (304)..(304): a, c, t, g, unknown or other
  misc_feature (304)..(304): n is a, c, g, or t
  modified_base (395)..(395): a, c, t, g, unknown or other
  misc_feature (395)..(395): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggtctattttaaaaggtgtcaagtgtgcggtgaaggtattggagtcgtggggaggcttggtacaggccggggggtcctgacactctcctgtgcagcctctggattcacagtcagcagcaatgccagtgtagttcgggtccnccgaggcctccggaaggggtaagggggttgcgagggttcggggtcgtacgggggtattagggaagtgacgtggtcgccacacaacgtacgngacgaccgtccgggtggacggggaccctctacgactcactcgtaccgaagaacgaacgtaacttaaccgaaaacacgtagtacgtaactcgtaggacgtaaatcgtaacgaccgccgtacgacggcccggaccgaacggaccgtaccggtcccgttccttaccgttcgtcgttacgtaaacgtaacgttaacccgttcgtttaccggttttaaccggggcccggtaacccggacccggtaccggttaccggtccgggggttaacccgtaacccgggg

SEQ ID NO: 356479 - DNA, 535 bp, Homo sapiens
  misc_feature: GZ8MTXP01A3OVA.22.36.D03.1.454.CMB.2.raw
  modified_base (396)..(396): a, c, t, g, unknown or other
  misc_feature (396)..(396): n is a, c, g, or t
  modified_base (418)..(418): a, c, t, g, unknown or other
  misc_feature (418)..(418): n is a, c, g, or t
  modified_base (507)..(507): a, c, t, g, unknown or other
  misc_feature (507)..(507): n is a, c, g, or t
  modified_base (532)..(532): a, c, t, g, unknown or other
  misc_feature (532)..(532): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccgcttcatcatctccagagacgattaccgaaaacacagtgaatctgacaaatgtacagcctcagcgccgaggacacggccgtctacttctgtgcgaaagacctcttagttttggccgcggccgacctacgtggggccagggcaacccgtggtcaccgtctcttcagcctcaccacggcccancgtcctcccctgcgccctgccnccaggcgcacctccggagcggcacgacgccgcccgtgggcctcgcccgtggtccgaacggcctaaccttccaacgccgtatcgttccgnggcggcggcgtcggcgacggctcgngtg

SEQ ID NO: 356480 - DNA, 589 bp, Homo sapiens
  misc_feature: GZ8MTXP01EP0ZZ.22.36.D03.1.454.CMB.2.raw
  modified_base (359)..(359): a, c, t, g, unknown or other
  misc_feature (359)..(359): n is a, c, g, or t
  modified_base (399)..(399): a, c, t, g, unknown or other
  misc_feature (399)..(399): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtccctgacactctcctgtgcagcctctggattcacagtcagcagcaatgccatgagttggccgcaggctcgagggaaggggttgcgaggtgggtcgtcgggggtattggaaagtgagtggtnacccgacacaacgtacgcagacgtccgtggacgggggccncttcatcatctccagacgacgacttaccgaaacacgagagaatcacgggataaagtgtaacaacgcctacacggaccgccggacggaccgaccggggccctccgttaacttcgtgttacgacggtaaacgacccgttcgttacgttttcgggccgtccggtcccgacgttacgtcgggccggtaaccggg

SEQ ID NO: 356481 - DNA, 662 bp, Homo sapiens
  misc_feature: GZ8MTXP01EAHKF.22.36.D03.1.454.CMB.2.raw
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (321)..(321): a, c, t, g, unknown or other
  misc_feature (321)..(321): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgactagttgggtctttgactctgtctctgtaccaacaacacccacgaccaacccccatcatcatttangtntcactcgtcgcctnagatctctcatcgcttctcagctaccgaagtctacggacaacgaccgtccctaccctaactactctcgtcgggccttccgtagtttcgaagggtacgtagttaccttaactttacgttaacggttgtaccgttaacggttttaccctttaaaagttacgggtccgtccttaacctttccgttccgggtttcggggttttccgggaccgggtaacgggtccgttaaacccgggtaaacggttccggtaaccccggttcccgttccggggttaccacccgggtaaccccaaaggggtccccttcccggtccccccgttacggttcccttaacccgtttccccg

SEQ ID NO: 356482 - DNA, 563 bp, Homo sapiens
  misc_feature: GZ8MTXP01EANTN.22.36.D03.1.454.CMB.2.raw
  modified_base (469)..(469): a, c, t, g, unknown or other
  misc_feature (469)..(469): n is a, c, g, or t
  modified_base (475)..(475): a, c, t, g, unknown or other
  misc_feature (475)..(475): n is a, c, g, or t
tcagacatacgcgtcacgaccggtgctcgatttagctgcgtcacgatctctcttggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacgaggccggggggtccctggacactctcctgtgcagcctctggattcacagtcagcagcaatgccatgagttggtccgccaggctccgaggggagggttgcgagtgggtcgtggggattggaagtgacgtggtcgccacacaactacgcgagaccgtccgtaggacgggggccactttcgactcatctccagacgaacgacttaccgaaaacacagtagaatctaggacaaatcgtacacgccncacgcnccgagaccgacggccgtctacttctgttcgacgtaacgaccttcttagttttggccgtcggtccgacgttacggtcgggccgaacggg

SEQ ID NO: 356483 - DNA, 662 bp, Homo sapiens
  misc_feature: GZ8MTXP01C5HMY.22.36.D03.1.454.CMB.2.raw
  modified_base (310)..(310): a, c, t, g, unknown or other
  misc_feature (310)..(310): n is a, c, g, or t
  modified_base (415)..(415): a, c, t, g, unknown or other
  misc_feature (415)..(415): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagtcgttggtacgaggcccggggggtccctgacactctcctgtgcagcctctggattcacagtcagcagcaatgccatgagttcggccncgaggctaccgaggggagggtgacgaggtcgggtgtcggggtattgggaagtggagtggtacgccaacgacacgtacgacgagaccgtccggtaggacgggtccncgttacatctaacgtctaccgagacgaacgtaactaaccgaaaacacgtaaggtacgaaactcgtaacgaactaaagtacgttacgaaacgtcccgtacgacgggcccggaacccggaaacgggaacccgaccgggtccccgttacgttaacccgttcgttacgggttcgaaccggtaaaaccgttacccgttaacgtttaacgggtttttcggggaccccggttccgggaacccggttaacccggg

SEQ ID NO: 356484 - DNA, 633 bp, Homo sapiens
  misc_feature: GZ8MTXP01ATOHX.22.36.D03.1.454.CMB.2.raw
  modified_base (365)..(365): a, c, t, g, unknown or other
  misc_feature (365)..(365): n is a, c, g, or t
  modified_base (404)..(404): a, c, t, g, unknown or other
  misc_feature (404)..(404): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctctgtgcagcctctggattcacagtcagcagcaatcgccatgagttgggtcccgcacggctccgagggggtaagggggttcgcgagggtgggtcgtcgggggattggaagtgagtggngccacacaactacgcagaccgtccggtgacgggggtccncttacattcaattccgaccgagacgaacggtacttaaccggaaaacacgaagtacggaaactccgtagggacctaaaagtcggtaacacgccctacgacggccgacccggaggtaccacggcccgtctacgttctggttcgaacgtaaacgcccgtttacgttcggttttccggggcccgaaccgggacccggtaacgttaccgggtccggggaacccgtaacccgggg

SEQ ID NO: 356485 - DNA, 598 bp, Homo sapiens
  misc_feature: GZ8MTXP01BWDZH.22.36.D03.1.454.CMB.2.raw
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
  modified_base (440)..(440): a, c, t, g, unknown or other
  misc_feature (440)..(440): n is a, c, g, or t
  modified_base (596)..(596): a, c, t, g, unknown or other
  misc_feature (596)..(596): n is a, c, g, or t
tcagacatacgcgtcacgaccggtgctcgatttagctgcgtcacgatctctcttggggttttggggggggtccctgacactctcctgtgcagcctctggattcacagtcagcagcaatgccatgagttgggtccgccaggctccgaggggaaggggttgcagtgggtctcggggattgggaagtgatggtgccacacactacgcagactccgtggaggggccncttcatcatctccagagacgattaccgaaaacncagtgaatctgacaaatgtacagcctcagcgccgaggacacggccgtctacttcgtgtcgacgaaacgtcctcgttagttttcgggccgcggccgacctacggtcggggccgacggggccaacccgtggtccaccgtctcttcacgcctaccaccaacgggccctagtccggtcccttccccgnggcccgcctcgcctccgacggtacgccacccgtccgggacgcggcccaacgcggcccggcccgtggggcctggtcccgtgtaccgaacggaaccttacttccgaacgttcgtacgtcgttcgttggcgggccgggcgcgggcgaacgggcgaacgntg

SEQ ID NO: 356486 - DNA, 694 bp, Homo sapiens
  misc_feature: GZ8MTXP01DXX9K.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatgccatgagttggccgcaggctccgaggggaagggttgcgaggttgggtcgtcgggggtattggggaagtggagtgggtacgacccacaccgaaaccgtacgcgaaggtacccgtcccgggtagggacgggggtcccgtcttaccacttcaacgtccgtacccgaaggaacgaaccgtaacgttaacccggaaaaacaccgtaacgttaagaaacttaccgtaaggggaaccgtaaattacggtaaacacggtacccttacgacggaccgaccggaacggaaccgacccgggtcccgttaacgttaaccgtttcgtacgttacggtaaacgtaaaccgttaccgtttcgtttacggttttccgggaccggtccggaccgtaccgttacggtaacggggcccgtaaccgggg

SEQ ID NO: 356487 - DNA, 642 bp, Homo sapiens
  misc_feature: GZ8MTXP01CDG35.22.36.D03.1.454.CMB.2.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (314)..(314): a, c, t, g, unknown or other
  misc_feature (314)..(314): n is a, c, g, or t
  modified_base (350)..(350): a, c, t, g, unknown or other
  misc_feature (350)..(350): n is a, c, g, or t
  modified_base (391)..(391): a, c, t, g, unknown or other
  misc_feature (391)..(391): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaaccaacngtgactagttgggtctttgactctgtctctaggtaccaacaacacccacgaccaaaccccccatcatctatttatgtntcactcgtcgcctcgaggactctcctcatcgcttcncacggctacaagtctggaccaacgcgtccctaccctaaccntctcgtcggaccttccgtagtttgacggtacgtagttaccttactttacttacggttagtacctttaacgtttacccgtttaaaagttccggccgtaccttaaccgttcgttccggtttcgggttttccggcgggtaacgtaccgaaccggtaacgttccggtaaccccggttccgttaccgggttccgaccgtccccgtaagggtcccttacccggtcccccgttcggttaacccttaaccgtttccccg

SEQ ID NO: 356488 - DNA, 677 bp, Homo sapiens
  misc_feature: GZ8MTXP01CJWDD.22.36.D03.1.454.CMB.2.raw
  modified_base (219)..(219): a, c, t, g, unknown or other
  misc_feature (219)..(219): n is a, c, g, or t
  modified_base (334)..(334): a, c, t, g, unknown or other
  misc_feature (334)..(334): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctggacccagtctgccctgacccagcctgcctccgtgtctggatcatctggacagtcgatcagctatttccngcacgtcgggaaccaacagtgactagttgggtctttgactctgtctctgtaccaacaaccaccacgacccaaacccccatcatctattatgtctctactcgtccggcctgaggtntctcctcatcgtcttccgacacggtcctaccgtaaagtccgtacggaccaaaccgaccggtacccctacccctaaacctacttccgttacgtcgggtccttacccgtaaggtttacggaacggtaaccgtacgttaccttaactttaactttacggtcgttaacttaacgtttaaccctttaaaagtccggtcctaccgtaccttccggttacggtttcggggtttaccgggcggtaaggtacccgttacggtaacggttccggtaacccgtccgttaccgggttccaccggtcccgaacgggtccctcccggtcccccgttacggtcccttccgtttccccg

SEQ ID NO: 356489 - DNA, 649 bp, Homo sapiens
  misc_feature: GZ8MTXP01BLJTG.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttgggtacgaggccggggggtccctgacactctcctgtgcagcctctggattcacagtcagcagcaatgccatgagttcggccgcgaggctccgaggggtaagggttgcgaggtgggtcgtcgggggattggaagtgagtggtacgccaacacaacctacgcgaacgaccgtcccgggtagggaccgggggtcctcgttacactacactccgtccgaaggacgaacgtaacttaaccgaaaacacaagtagaaatctaggaactaaagtacgtaacgacgcctacgacgaccggaccggaacggaccgaccggtcccgtaaccttaacgttccgtggttacgaacgtaaacgttaccgttacgtttacggtttttccggggcccggtccggtacccggtacgttaccgggtccggggccggtaacccgggg

SEQ ID NO: 356490 - DNA, 646 bp, Homo sapiens
  misc_feature: GZ8MTXP01BZ3QQ.22.36.D03.1.454.CMB.2.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (325)..(325): a, c, t, g, unknown or other
  misc_feature (325)..(325): n is a, c, g, or t
  modified_base (329)..(329): a, c, t, g, unknown or other
  misc_feature (329)..(329): n is a, c, g, or t
  modified_base (334)..(334): a, c, t, g, unknown or other
  misc_feature (334)..(334): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaaccaacngtgactagttgggtctttgactctgtctctcgtaccaacaaccaccacgacccaaacccccatcatctattangtnctactcgcgcctnaggntctcnctatcgcttctacacgctactaaagtctacggacaaaccgccgtcccctaccctaaacctactccgtcgtcgggtaccttcccgtaggtttacggacggtacgtacgttaccttaactttacttacgtagttaccttaacgtttaaccctttaaaagtccggtaccgtaccttaacccgttcgttaccgggtttcgggttttaccggcggggtaacgtacccgacgtaaacggttccgtaacccgtccgttaaccggttcaaccggtcccacgggtccctccggcccccgttcggtcccttaaccgttcccg

SEQ ID NO: 356491 - DNA, 617 bp, Homo sapiens
  misc_feature: GZ8MTXP01DQD8Q.22.36.D03.1.454.CMB.2.raw
  modified_base (299)..(299): a, c, t, g, unknown or other
  misc_feature (299)..(299): n is a, c, g, or t
  modified_base (322)..(322): a, c, t, g, unknown or other
  misc_feature (322)..(322): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatgccatgagttggccncaggctccgaggggaaggggttncaggtgggtcgtgggggattgggaatgatggtgccacacaactacgcagacctccgnggacggggccncttcatcatctccagagaacgacttaccgaaaacacagtagaatctaggacaaatagtaacacgccctcgacgaccgccggtaacgggaacccgaaccgggtcccggttaacctaaccgtttaccgtggttacggaccggtaaaacgaacccgtttcgtttaacggttttttcggggcccggtccgggacccggtaccgttaccggtcgggggcccgtaaccggggg

SEQ ID NO: 356492 - DNA, 678 bp, Homo sapiens
  misc_feature: GZ8MTXP01A767P.22.36.D03.1.454.CMB.2.raw
  modified_base (279)..(279): a, c, t, g, unknown or other
  misc_feature (279)..(279): n is a, c, g, or t
  modified_base (307)..(307): a, c, t, g, unknown or other
  misc_feature (307)..(307): n is a, c, g, or t
  modified_base (377)..(377): a, c, t, g, unknown or other
  misc_feature (377)..(377): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggcttaattttaaaaggtgtcaagtgtgcggtgaaggtattggagtcgtgggggaggcgttggtacgaggccggggggtccctgaccactctcctgtgcagcctctggattcacngtcagcagcaatgccatgagttcggccncgaggctaccgagggggtaagggttgcgtagggtgggtcgtacgggggatttagggaagtgagtgggtcncccgaacacaaccgtacgcgtacgaccgtcccgggtaggacgggggccctcgtttacactcactccgtaccgaacgaagaaccgtaacttaaacccgaaaaccacgaacgtaagtaaacgtcgtacgggaactaaagtacgtaaccgacgtcccacgacggaccgaccggaacggaccgaacccgggcccgttccttaccgttcgtacgttacggaaaccgtaaacggttaccgttcgtttaccggttttcggggcccgtccgggtcccgaccgttaccgggtcggggccgtaacccgggg

SEQ ID NO: 356493 - DNA, 673 bp, Homo sapiens
  misc_feature: GZ8MTXP01EM4L2.22.36.D03.1.454.CMB.2.raw
  modified_base (234)..(234): a, c, t, g, unknown or other
  misc_feature (234)..(234): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (321)..(321): a, c, t, g, unknown or other
  misc_feature (321)..(321): n is a, c, g, or t
  modified_base (340)..(340): a, c, t, g, unknown or other
  misc_feature (340)..(340): n is a, c, g, or t
  modified_base (384)..(384): a, c, t, g, unknown or other
  misc_feature (384)..(384): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacngtgactattgggtctttgactctgtctctggtaccaacacacccagaccaaaccccccatcatctattangtntcactcgtcgcctnaggctctctcatcgcttcncagctcaagtctacggaccaacgaccggtccctaccctaaaccnttcctcgtcgggtccttacccgtagtttacgaacggtacgtacgttaccttaaactttacttacggtgttaccgttaacgttttaacccgtttaaaatcgggtaccctaccgtaaccgttccgttcgggtttcggggttttccggcggggtaacggtaccgttaaccgggtaaacggttcgggtaaccccggtttcccgttaccgggggttccaaacccgggtccccgtaaaccgggtcccgttccccgggtccccccgttaccggggtcccttaacccggtttccccg

SEQ ID NO: 356494 - DNA, 575 bp, Homo sapiens
  misc_feature: GZ8MTXP01D6L96.22.36.D03.1.454.CMB.2.raw
  modified_base (216)..(216): a, c, t, g, unknown or other
  misc_feature (216)..(216): n is a, c, g, or t
  modified_base (316)..(316): a, c, t, g, unknown or other
  misc_feature (316)..(316): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagcatttccngcactgggaccaacagtgactatttgggtctttgactctgtctctgtacaacaacaccagccaaacccccatcatcatttatgtgtcactcgtcggcctnagagtctctccatcgtctctcaacggcctccgaagtctacggcaaccgacggccctaccctaacatctcgtcgggcctccgtagtttcgaggtacgagttactattacttactggtacttagtttacctttaaagtacggcctcctacttcgtcggttcggtttccggcggtacggaacctacggaacgttcgaccgttccgtcggttaccgacgcccgaaggtccctccgccccgtggttaccctcttccgttccccg

SEQ ID NO: 356495 - DNA, 638 bp, Homo sapiens
  misc_feature: GZ8MTXP01D25R7.22.36.D03.1.454.CMB.2.raw
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (320)..(320): a, c, t, g, unknown or other
  misc_feature (320)..(320): n is a, c, g, or t
  modified_base (323)..(323): a, c, t, g, unknown or other
  misc_feature (323)..(323): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcactgggaccaanagtgactagttggtctttgactctgtctctgtaccaacaacacccacgaccaaacccccatcatcatttangtntcactcgcgcctnagntctcctcatcgcttctcagtctacaagtctacggacaacacgccctaccctaacctatcctcgtcgggacccttccgtaggttttggaacggtacgtacgttacttaactttattacgtgtacgttaacgtttaccttaaaagttcggccgtcctaacgttcgttccggtttcggtttccgggacggtaacggtaccgaaccggtaaaggttccgtaacccggttccgttacggggttccaaccgggttaaccccaaacgggtcccgttccccggtacccccgttccgggtaacccttaacccgggtttcccccg

SEQ ID NO: 356496 - DNA, 618 bp, Homo sapiens
  misc_feature: GZ8MTXP01EFLOW.22.36.D03.1.454.CMB.2.raw
  modified_base (224)..(224): a, c, t, g, unknown or other
  misc_feature (224)..(224): n is a, c, g, or t
  modified_base (257)..(257): a, c, t, g, unknown or other
  misc_feature (257)..(257): n is a, c, g, or t
  modified_base (473)..(473): a, c, t, g, unknown or other
  misc_feature (473)..(473): n is a, c, g, or t
  modified_base (615)..(615): a, c, t, g, unknown or other
  misc_feature (615)..(615): n is a, c, g, or t
tcagacatacgcgtcacgaccggtgctcgatttagctgcgtcacgatctctcttggggttttggggggggtccctgacactctcctgtgcagcctctggattcacagtcagcagcaatgccatgagttgggtccgccaggctccgaggggaaggggttgcagtgggtctcggggattgggaagtgatggtgccacacactacgcagactccggtggaggggccncttcatcatctccagagacgattaccgaaaacncagtgaatctgacaaatgtacagcctcagcgccgaggacacggccgtctacttctgtgacgaaacgtccttcttagtttttcgggccggcggccgacctacgtcgggggcccgacgggcaaccccgtggtccaccgtctcttcacgtcctccgaccgtaacgggccctacgtccggtcccttcccccgtggcccgcccgttcgcctccgacggacnccgaacccgtccgggagacgccacgacggccggcccgttgggcctcggcctcgggtccaagggaaccttaaccgttcccgacggttcgtacgtcggttcgttcggacgggccgggtcgtcgggccgaagggccgggtaacgngtg

SEQ ID NO: 356497 - DNA, 519 bp, Homo sapiens
  misc_feature: GZ8MTXP01BJ7VS.22.36.D03.1.454.CMB.2.raw
  modified_base (219)..(219): a, c, t, g, unknown or other
  misc_feature (219)..(219): n is a, c, g, or t
  modified_base (250)..(250): a, c, t, g, unknown or other
  misc_feature (250)..(250): n is a, c, g, or t
  modified_base (413)..(413): a, c, t, g, unknown or other
  misc_feature (413)..(413): n is a, c, g, or t
  modified_base (426)..(426): a, c, t, g, unknown or other
  misc_feature (426)..(426): n is a, c, g, or t
  modified_base (504)..(504): a, c, t, g, unknown or other
  misc_feature (504)..(504): n is a, c, g, or t
  modified_base (515)..(515): a, c, t, g, unknown or other
  misc_feature (515)..(515): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgagggaagggttgcaggtgggtctcggggattgggaagtgatggtgccacacactacgcagactccgtgaggggccncttcatcatctcagagacgattccgaaaacncagtgaatctgcaaatgtacagctcagcgcgaggacacggccgtctacttctgtgcgaaagacctcgtatttttgggccgcggccgacctacgtggggccgagggcaaccctggtcacgtctcttcagcctccaccaacgggccatcggtcttcccctggccnccctgctcgacgnccaccgtcggacgacgcacgagccgcccgtggctcgccgtgtcaaggctacgttccacgcgtatgcgttgacgcggcncggcaggcgcngaag

SEQ ID NO: 356498 - DNA, 684 bp, Homo sapiens
  misc_feature: GZ8MTXP01BNVSZ.22.36.D03.1.454.CMB.2.raw
  modified_base (309)..(309): a, c, t, g, unknown or other
  misc_feature (309)..(309): n is a, c, g, or t
  modified_base (332)..(332): a, c, t, g, unknown or other
  misc_feature (332)..(332): n is a, c, g, or t
tcagacatacgcgtcacgaccggtgctcgatttagctgcgtcacgatctctcttggggtggggtctcaggaggcagcgctctcgggacgtctccaccatggcctgggctctggctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctcctggtaccaacaacacccacggccaaacccccccatcatcatttangtgtcactcgtcggccctcaggntctcctcatcgcttctcaggtcctacccgaagtctcgggactaaccgaccggtccctacccctaaccattcctacgtcgggccttaccgtagtttggacggtacgtacgttacttactttacttacgttacgtacgttacggtttacccttttaaaagtccgggtcccgtaccctaccgttccgttccggttttcgggttttccgggccggggtaacggtaccgacccgggtaaacggtttccggaccccgggttaccccgttcgggtttacccgaaccgggtcccccgtaaacgggtcccgttccccgggtcccccccgtttcggggttccccttaaccgttttcccccgg

SEQ ID NO: 356499 - DNA, 627 bp, Homo sapiens
  misc_feature: GZ8MTXP01C5XGS.22.36.D03.1.454.CMB.2.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (275)..(275): a, c, t, g, unknown or other
  misc_feature (275)..(275): n is a, c, g, or t
  modified_base (324)..(324): a, c, t, g, unknown or other
  misc_feature (324)..(324): n is a, c, g, or t
  modified_base (577)..(577): a, c, t, g, unknown or other
  misc_feature (577)..(577): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctgatcatctggacagtcgattagctatttccngcacgtggaccaangtgactagttggtctttgactctgtctctaggtaccaacaacncccgacgacccaaacccccatcatctattatgtgtcacgtcgtcgcctnaggctctctccatcgctttctcaacggtctaaccgaattccgaggaccctaaacgccggtcccctaaccaacctactcgtcgtcggtcctacgtaggttacggacgtacgtacgttacttactttacttacgtcggttaacgttaagttttaacctttaaagtcggtcccaccgttcgtttacgttcgggtttcggttccgggcggttacggaacaaccgggttagtccggttaccgttccgtccgggttacncgaccgtaacggtcctcccggccccgtgttcctaaccgttccgttccccg

SEQ ID NO: 356500 - DNA, 556 bp, Homo sapiens
  misc_feature: GZ8MTXP01ADZ40.22.36.D03.1.454.CMB.2.raw
  modified_base (289)..(289): a, c, t, g, unknown or other
  misc_feature (289)..(289): n is a, c, g, or t
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
  modified_base (316)..(316): a, c, t, g, unknown or other
  misc_feature (316)..(316): n is a, c, g, or t
  modified_base (334)..(334): a, c, t, g, unknown or other
  misc_feature (334)..(334): n is a, c, g, or t
  modified_base (336)..(336): a, c, t, g, unknown or other
  misc_feature (336)..(336): n is a, c, g, or t
  modified_base (354)..(354): a, c, t, g, unknown or other
  misc_feature (354)..(354): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacaatcgatcagcatttcctgcactgggaccaacagtgacattgggtctttgactctgtctctgtaccaacacacccagccaaacccccancatcatttangtntcactcgtcgcctnagatctctcatcgcttcncngctcaagtctggccaacncggccctaccctaacatctcgtcgggctcccgtaggtttgacggacgtacgttacttaactttattaacgtgtaccttaacgtttacctttaaagttacgggctaccctacttcgtcgttggtttcggcggtaagcacggtagttcgaacccgtcttcggttcacgccctagtcctccgcccccgttggtccttcgttcccg

SEQ ID NO: 356501 - DNA, 656 bp, Homo sapiens
  misc_feature: GZ8MTXP01BQW88.22.36.D03.1.454.CMB.2.raw
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacngtcagcagcaatgccatgagttggccncaggctccgaggggagggtgcgaggtgggtcgtgggggattgggaagtgagtgggtcgcccaacaccaaacgtacgcgaacggacctccgggtggacgggggtcccgcttacgactcactcctaccgaagacgaacgtaacttaacccgaaaacaccgtaagtagaacttccgtaggaactaaagttacgtaaccgtacgccctcgacgacccggaccggacggaccgaccggtcccggtaaccttaaccgttccgtcggttacgtaaccgtaaacgttacccgttcgtttacgggttttccggggcccggtccgggtcccgtaccggttaccgggtccggggcccgtaacccgggg

SEQ ID NO: 356502 - DNA, 649 bp, Homo sapiens
  misc_feature: GZ8MTXP01ENUKY.22.36.D03.1.454.CMB.2.raw
  modified_base (256)..(256): a, c, t, g, unknown or other
  misc_feature (256)..(256): n is a, c, g, or t
  modified_base (627)..(627): a, c, t, g, unknown or other
  misc_feature (627)..(627): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccgaggggaagggttgcaggtgggtctcggggattggaagtgagtggtgccacacactacgcagactccggtggacggggcctcttcatcatctcagagacgtataccgaaaacncagtgaatctagacaaatgtacagcctcacgcgccgaggacacggcctctactctgtgacgaaacgtaccttcgttagtttttcgggccgccggaccgtaccgtaccggtcggggcccgaacgggcccgtaacccgtcggtcccgtaccgttcctccttccgaccgtccctacccgaacccgaccgggtccctaacgtccggttccccttcccccgtggtccccgtccccgttcgtcccgaccgacggaccgaccgaccccgtacggggacgacgaccgaccgacggcccggtcccgtcgggccgtcgtccgtcgtaccgaacggtaacttaccgttccgtaacgcgttagtcgttcgttggacggcgggngcggacgagggctaacgaagtg

SEQ ID NO: 356503 - DNA, 607 bp, Homo sapiens
  misc_feature: GZ8MTXP01EWECD.22.36.D03.1.454.CMB.2.raw
  modified_base (301)..(301): a, c, t, g, unknown or other
  misc_feature (301)..(301): n is a, c, g, or t
  modified_base (359)..(359): a, c, t, g, unknown or other
  misc_feature (359)..(359): n is a, c, g, or t
  modified_base (398)..(398): a, c, t, g, unknown or other
  misc_feature (398)..(398): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggagcttggtacaggccggggggtccctgacactctcctgtgcagcctctggattcacagtcagcagcaatgccatgagttgggccnccgaggctccgaggggagggttgcgaggtgggtcgtgggggattggaagtgagtggtncccacacaactacgcagacctccgggtggacgggggccncttcatcatctccagagacgaacttaccgaaaacacagtagaatcgtagacaaagtcgtaacacgcctacgacgaccgccgaacggaccgaaccggcccgtaacttaccgttcgtcggttacgacgtaaaacggttacccttcgtttacgtttttccggggcccgtccgggcccggtaccgttaccggtcggggttcccgtaaccgggg

SEQ ID NO: 356504 - DNA, 566 bp, Homo sapiens
  misc_feature: GZ8MTXP01A6PU6.22.36.D03.1.454.CMB.2.raw
  modified_base (299)..(299): a, c, t, g, unknown or other
  misc_feature (299)..(299): n is a, c, g, or t
  modified_base (320)..(320): a, c, t, g, unknown or other
  misc_feature (320)..(320): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatgccatgagttggccncaggctccgagggaagggttncgaggtgggtctcgggggattggaagtgagtggtagccacacaactacgcacgacctccggtggacgggggccacttcactcatctcagagacgacttaccgaaacacagtagaatctaggacaaatgtaacacgcctcgacgccgccgacggaccgaccggccgtctacgttcgtcgttcgacgaacgttccgttcttacgttttcgggccgtccggccgtacgttacggtcgggccgaaccggg

SEQ ID NO: 356505 - DNA, 737 bp, Homo sapiens
  misc_feature: GZ8MTXP01AOZJ3.22.36.D03.1.454.CMB.2.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaaccaangtgactagttgggtctttgactctgtctctagtaccaacaccaccgacgacccaaaccccccatcatctatttatgtctctactcgtccggccctagaggtactctcctcacttccgtcttacctacgacggtcccttaccgaaacgttccgtacgggacctaaccgtacccggtaccccttacccctaacaccgttcgtaccgtcggggtacccttaccgtacggtttacgaacgggtaacgtacggttaaccttaacgtttaacgtttacggtacgttaccgtttaaccgtttaaacccgttttaaacgttaccgggacccgttacccttacgtttcccgttcggggtttacgggttttaccggggacgggtaacggtacccgttaaaccggtaacggttccggtaaaccccggttccggttacggttcccgttaccggtaaccccgtaacgggtccccttcccggtcccccgttaccgggtcccttaacccgttccccg

SEQ ID NO: 356506 - DNA, 629 bp, Homo sapiens
  misc_feature: GZ8MTXP01BSXMJ.22.36.D03.1.454.CMB.2.raw
  modified_base (393)..(393): a, c, t, g, unknown or other
  misc_feature (393)..(393): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctcctgtgcagcctctggattcacagtcagcagcaatgcatgagtggccgcaggctccgagggaagggttgcgaggtgggtcgtcggggattggaagtgagtggcgccacacaaccgtacgcagaccgtcccggtggacggggcccncgttcatcatccgtccaagacgaacgtacttaacccgaaaacacgagtacgaatcagggaactaaagtcgtaacacgtcctagacggccgaccggacggaaccgacccggggtcctcgttaacgtttcccgtaggttacgaaaccggtaacgttacccgttcgtttacggttttccgggggacccgttcccgggcccggtaacgttaccggggttccggggccggtaacccggggg

SEQ ID NO: 356507 - DNA, 664 bp, Homo sapiens
  misc_feature: GZ8MTXP01A5Y1D.22.36.D03.1.454.CMB.2.raw
  modified_base (330)..(330): a, c, t, g, unknown or other
  misc_feature (330)..(330): n is a, c, g, or t
  modified_base (373)..(373): a, c, t, g, unknown or other
  misc_feature (373)..(373): n is a, c, g, or t
  modified_base (410)..(410): a, c, t, g, unknown or other
  misc_feature (410)..(410): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtccctgacactctcctgtgcagcctctggattcacagtcagcagcaatgccagtgagttcgggtcccgccaggctccgagggggaaggggttncgaggtgggtcgtcgggggattgggaagtgagtggtgcccaanaccaacgtacgcagaccgtccggtggacgggggtccncttcactcatcctccaagacgaacgtaacttaaccggaaaaccacgaacgtagaaacttcgtacggggaactaaaagtcgtaacacgcctcgacgaccggaccgacggacccaccgggcccgttaacctaacgtttccgtacggttacggtaaaccggtaaaacgttcccgtttcgtttaccggtttttcgggggccccggtccgggacccggtaaccggttaccgggtccgggggaacccggtaacccggggg

SEQ ID NO: 356508 - DNA, 721 bp, Homo sapiens
  misc_feature: GZ8MTXP01C20EV.22.36.D03.1.454.CMB.2.raw
  modified_base (220)..(220): a, c, t, g, unknown or other
  misc_feature (220)..(220): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcgagtctactttcncgacgacgtacgggaaccaagtagtacgacgttaggtttcggtttctttacgctctcgtcctcgtacgtaaccaaacaacccaccgaccgaaccccaaacccccctatactactacgttatttacgtcggtactcctaccgttccggccgtcctagacggtctcctcctacgactcgtcttcaacgacgtcctacgtaacgtcgtacgaaccaccgaccgtccctaaccctacacttctcgtggtccctacgttaggttacgacggtaacgtacttacttaactttaacgtacgtcttaacgtttaaacgtttaacccgttaaaagttccggccgttacctaaccgtttcgttaaccggggttttcgggttccgggagggtaaaccgtccgttaaaccgggtagttaccggttacccggtccgtttacggccgaacccggaaccgtaacggttccccgtcccgggtacccccgttcgggttaaccttcccggtttccccgg

SEQ ID NO: 356509 - DNA, 713 bp, Homo sapiens
  misc_feature: GZ8MTXP01DL6I7.22.36.D03.1.454.CMB.2.raw
  modified_base (275)..(275): a, c, t, g, unknown or other
  misc_feature (275)..(275): n is a, c, g, or t
  modified_base (306)..(306): a, c, t, g, unknown or other
  misc_feature (306)..(306): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgaccactctcctgtgcagcctctggattcacngtcagcagcaatcgccatgaggttcggcccnccgaggctccgaagggggtagggttgcgtagggttgggtcgtgggggtatttagggaagtggaacgtggtacgcccaacacaaacccttacgccgaaggtaacccgttccgggtagggaaccggggggtcccctacttaccctacgttaccacttcccgtaccgaagaacggtaacgtaaccgttaacccggaaaaccaaccgtaagtagaaacttccgttaggaactaaaacgttacgtaaccgaacgtacccgtaccgaacggaccggacccgaacgggtaacccgaccgggtacccgttaacttaactttacgtacgttacgtaaccgtaaacgttaccgtttcgtttacgttttcggggcccggtccggtacccgacgttacgggtccggggccgtaaccggg

SEQ ID NO: 356510 - DNA, 645 bp, Homo sapiens
  misc_feature: GZ8MTXP01CQJ1I.22.36.D03.1.454.CMB.2.raw
  modified_base (314)..(314): a, c, t, g, unknown or other
  misc_feature (314)..(314): n is a, c, g, or t
  modified_base (634)..(634): a, c, t, g, unknown or other
  misc_feature (634)..(634): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtcgggaaccaacgagtgactagttgggtctttgactctgtctctgtaccaacaacacccacgaccaaacccccactcatctattatggtntctactcgtccgcctcgagagtctcctctatcgtcttctcacggcctacctaaagtccgtcggaccaaccgaccggtcccctaccctaaccactcctcgtcgggtaccttaccgtaggtttgaacggtacgtacgttacttaacttattaccgtagtacttaacgtttaccgtttaaagtcgtccgtaccctacgttccgttcgggttacggtttccgggcgggtaacggtccgttaaaccggtaacgttcgtaaacccgttccgttaccgggttcaccggtaacccgaacggtccgtcccgtccccgttcggtaacccncccgtttcccg

SEQ ID NO: 356511 - DNA, 607 bp, Homo sapiens
  misc_feature: GZ8MTXP01BX5JK.22.36.D03.1.454.CMB.2.raw
  modified_base (228)..(228): a, c, t, g, unknown or other
  misc_feature (228)..(228): n is a, c, g, or t
  modified_base (263)..(263): a, c, t, g, unknown or other
  misc_feature (263)..(263): n is a, c, g, or t
  modified_base (303)..(303): a, c, t, g, unknown or other
  misc_feature (303)..(303): n is a, c, g, or t
tcagacatacgcgtcacgaccggtgctcgatttagctgcgtcacgatctctcttggggttttggggggggtccctgacactctcctgtgcagcctctggattcacagtcagcagcaatgccatgagttgggtccgccaggctccgaggggaaggggttgcaggtgggtctcgggggattgggaagtgatgggtgccacacactacgcagacctccgtggacggggccncttcatcatcctccagagacgacttaccgaaaacncagtgaatctgacaaatgtacagcctcagcgccgaggacncggccgtctacttctgtgacgaaacgtccttcttagttttcgggccgcggccgaccgtacggtcggggccagggcctaacccgtggtcaccgtctcttcacgccctcaccgacggcccacgtccggtcccttcccccggtggccccgccctcgtcctccgacgggacgccaccccgtccggggaagcgccacgacggccggtcccgtgggcctcggccctggtaccgacgggtcccttacttccgacgttcgtacgtcgttcgttcggcggtcggggcgtcgggacgacgggcgcgttaagcgg

SEQ ID NO: 356512 - DNA, 684 bp, Homo sapiens
  misc_feature: GZ8MTXP01D5B2B.22.36.D03.1.454.CMB.2.raw
  modified_base (673)..(673): a, c, t, g, unknown or other
  misc_feature (673)..(673): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaaccaacagtgactagttggtctttgactctgtctctgtaccaacaacacccacgaccaaaccccccatcatctatttatggtgtcaccgtcgtccggcctcgaggagtcctccgtcactccgtcttctaccacgtcctacgaacgtcgtacggacctaaccgaccggtccccttaccctaacctacttccgtcgtcgggtaccttaccgtaggtttcggaacggtacgttacgttccttaaactttactttacggtacttaccgtttaaacgttttaaccgttttaaacgtacggtcccgtaccgtaaccgtttccggtttcgggtttcggggttttccgggcgggtaaccggacgttaaccggtaaggttccggtacccgttcgttaaccggttccgaccggtcccgtaacggtccgtcccggccccgttccggttaacccnccgtttccccg

SEQ ID NO: 356513 - DNA, 609 bp, Homo sapiens
  misc_feature: GZ8MTXP01AY74G.22.36.D03.1.454.CMB.2.raw
  modified_base (237)..(237): a, c, t, g, unknown or other
  misc_feature (237)..(237): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaaccaacgngtgaactagttgggtctttgactctgtctctagtaccaacaaccacccacggacccaaaccccccaatcactctatttatggtacgtaactcgtccgccctcgacggatctctccatcgtcttccnaacggtctccgaagtcgngtaccaacgaccggaccctacccctaaacattcctcgtcgggcctccgtaggttcgaggtacgagttctaacttattactcgtacttaacgtttccttaaaagttcggcctactacttcgttcgtacgggttttcggacgtggctaacggttaagtcgaccggttcctcggttaccgcgacccgaagggtcctccggaccccttcggacctcgttcccgttaaccccg

SEQ ID NO: 356514 - DNA, 698 bp, Homo sapiens
  misc_feature: GZ8MTXP01BG4IJ.22.36.D03.1.454.CMB.2.raw
  modified_base (301)..(301): a, c, t, g, unknown or other
  misc_feature (301)..(301): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggagcttggtacaggccggggggtcctgacactctctgtgcagcctctgattcacagtcagcagcaatcgccatgagttcgggtacccncgaggctaccggagggggtaaggggttgcgtaggtgggtcgtcgggggtatttgggaagtggagtgggtcgcccacaccaacgtacgcgacggtaccgtcccgggtaggacgggggtccctacttaccacgtctactccgtaccgaaggacgaaccgtaacttaacccgaaaaccgacgtaacgtaggtaactacgttacgggaactaaagttacgtaaccgtaccggaccctacgacggacccggaccggaacgggaacccgtacccgggtcccgttccgttaaccgttcgtacggttcggaaccggtaaacgttacccgtttcgtttacggtttttccgggacccggtccgggtacccggtacggttaccgggttcggggcccggtaacccgggg

SEQ ID NO: 356515 - DNA, 696 bp, Homo sapiens
  misc_feature: GZ8MTXP01A0A3Z.22.36.D03.1.454.CMB.2.raw
  modified_base (313)..(313): a, c, t, g, unknown or other
  misc_feature (313)..(313): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggtcttaattttaaaaggtgtcaagtgtgcggtgaaggtattggagtcgtgggggaggcgttggtacgacgggccggggggtccctgacactctcctgtgcagcctctggattccacagtcagcagcaatgccatggagttcgggtcccncgaggctaccggagggggaagggggttgcgtagggtgggtcgtgggggtattgggaagtgatgggtcgaccacacaactacgcaggtacctcccgggtggacgggggtcctcgttcactccactccgtaccgaaggacgtaaccgtaacttaacccgaaaaacacgaaggtactaaacttccgtaggggaacctaaaagttcggtaaccacgtccccgacgacggaccccggaccggtaacgggacccgaaccgggtcccgttaacctttcgttcgttacggttaccgaaccgtaaaacgttccccgtttcgtttaccggttttcggggaccccggtccgggtacccggtacgttaccggggtccggggcccgtaacccgggg

SEQ ID NO: 356516 - DNA, 700 bp, Homo sapiens
  misc_feature: GZ8MTXP01CK6LZ.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacgagtgactagttggttctttgactctgtctctcgtaccaacaaccacccacgacccaaaccccccaactcactctatttatcggttacgtaaccgttccgtccggccctagacggtacgtctctcctactcgtcttcctcgaacggtcctccgaaacgtccgtacgggaccctaaaccgtacccgggtcccctacccctaaacctactccttcgtcgggtccttacgtagtttacggacggtaacgtagttacttaacttaattacgttcggtacgtttaacgttttaacctttaaacgtacggtccgtaccctacgtttccgttcgggtttcgggtttaccgggcgggtaacgtccgtaaccggttacggttacggaccccgttccgtccgggttaccgccgttaccccggtaacggccgttccccggtccccgtcggttaccctaaccgttcccgtttcccccg

SEQ ID NO: 356517 - DNA, 595 bp, Homo sapiens
  misc_feature: GZ8MTXP01DOJ01.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccgggggggtccctgacactctcctgtgcagcctctggattcacagtcagcagcaatgccatgagttggtccgccgaggctccgagggaaggggttgcgaggtgggtctcgggggattggaagtgagtggtgccacacaactacgcgagaccgtccggtggacgggggccctcgttacatcactcctaccagtaacgacgtacttaaccggaaacaaccaagtagaaatcctaggaactaaatagtacacgcctcgacgccgccgaggaccgcggccgtctacgttcgtcggttcgacgaacgttaccgttcgttacgtttttcgggaccgccgggtccgacgttacggtcgggccggtaaccggg

SEQ ID NO: 356518 - DNA, 636 bp, Homo sapiens
  misc_feature: GZ8MTXP01BANQI.22.36.D03.1.454.CMB.2.raw
  modified_base (286)..(286): a, c, t, g, unknown or other
  misc_feature (286)..(286): n is a, c, g, or t
  modified_base (318)..(318): a, c, t, g, unknown or other
  misc_feature (318)..(318): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttggctgaagtggcttttgcttgtggcttaattttaaaaggtgtcaagtgtgcggtgaaggtattggagtcgtgggggagcgttggtacgacggccggggggtcctgacactctcctgtcgcagtccctcgtggacttcacngtcagcagcaatgccagtgacgtttcgggccncgaggctccggaaggggagggttgcgtaggtgggtcgtcggggtattgggaagtgagtggacgaccctaacacgtacgtacgacgacggtaccgtcgggtggacggggcctctacgactcacttccgtaccgaaggacgaacgtaacttaacccgaaaactcgaagggtagtaaactctaagaactaaagtcgtaacgacgcctcgacgccggccggaaggaacccgaccgggtcccttacgttacgttcgttggttcgaacggtaaccgtaccgttcgtttaacggtttcgggacccgtaaccgggccggtaaccgg

SEQ ID NO: 356519 - DNA, 637 bp, Homo sapiens
  misc_feature: GZ8MTXP01AUC6K.22.36.D03.1.454.CMB.2.raw
  modified_base (246)..(246): a, c, t, g, unknown or other
  misc_feature (246)..(246): n is a, c, g, or t
  modified_base (305)..(305): a, c, t, g, unknown or other
  misc_feature (305)..(305): n is a, c, g, or t
  modified_base (366)..(366): a, c, t, g, unknown or other
  misc_feature (366)..(366): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcgttggtacgaggccgggggggtcccngaccactctcctgtgcagcctctggattcacagtcagcagcaatgccatgagttggccncaggctccgaggggaagggttgcgaggtgggtctgggggattggaagtgagtggtgcccancaaacgtacgcagacctcggtggacggggcccgcttcgactcatctccagagaacgacttaaccgaaaacacgagtagaagtctagggactaaagtgtaacacgccgtagacgccggccggaacggaccgaccgggtcccgttcgttaaccgttctcgggttacgtaaccggaaacgttacccgtttcgttaacggttttttccgggggacccggtcccgggtcccggtaaccggttaacccggttcgggggttccccggtaacccggggg

SEQ ID NO: 356520 - DNA, 619 bp, Homo sapiens
  misc_feature: GZ8MTXP01EGGEW.22.36.D03.1.454.CMB.2.raw
  modified_base (310)..(310): a, c, t, g, unknown or other
  misc_feature (310)..(310): n is a, c, g, or t
  modified_base (535)..(535): a, c, t, g, unknown or other
  misc_feature (535)..(535): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgactagttgggtctttgactctgtctctaggtaccaacaacacccagacccaaacccccatcatcatttatgtntcactcgtcggcctgaggatctcctcatcgtcttctacgacggctaccgaaagttcctaggaccaacgaccggtacccttacccctaacctactccgtacgtcgggtccttaccgtaaggttttacggacgggtacgtacgttacttaacttacttacgtacggtacttaacgtttaccttaaagtacgtccgtcctacgttcgttcggtttacgggtttccggngggtaacgtcgaacgtaggttcgaccgttccgttacggttcacgcccgaggtccgtccgccccgttcggtaaccttcgttcccg

SEQ ID NO: 356521 - DNA, 560 bp, Homo sapiens
  misc_feature: GZ8MTXP01DAHKE.22.36.D03.1.454.CMB.2.raw
  modified_base (209)..(209): a, c, t, g, unknown or other
  misc_feature (209)..(209): n is a, c, g, or t
  modified_base (269)..(269): a, c, t, g, unknown or other
  misc_feature (269)..(269): n is a, c, g, or t
  modified_base (278)..(278): a, c, t, g, unknown or other
  misc_feature (278)..(278): n is a, c, g, or t
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
  modified_base (352)..(352): a, c, t, g, unknown or other
  misc_feature (352)..(352): n is a, c, g, or t
  modified_base (355)..(355): a, c, t, g, unknown or other
  misc_feature (355)..(355): n is a, c, g, or t
  modified_base (376)..(376): a, c, t, g, unknown or other
  misc_feature (376)..(376): n is a, c, g, or t
  modified_base (386)..(386): a, c, t, g, unknown or other
  misc_feature (386)..(386): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggcttaattttaaaaggtgtcaagtgtgcggtgaaggtnttggagtcgtgggggagcttggacgaggccggggggtcctgacactctctgtgcagcctntggattcanagtcagcagcaatgccatgagtggccncaggctcgaggggtaggtncgagtggctggggatggagtgatggtcnccnacacgtacgcaggactccggnggacgggccncgttcatcactctccgaagacgacgacttaaccgaaaacacgaggtacgaactctagacaaagtcgtaacacgcctacgacgccggccggaacggacgcggtcccgttacttacgtcgttagttcgacgtaaacgtccttcgttacgtttcgggcccgtcggttcccgtaacgg

SEQ ID NO: 356522 - DNA, 517 bp, Homo sapiens
  misc_feature: GZ8MTXP01APY1H.22.36.D03.1.454.CMB.2.raw
  modified_base (368)..(368): a, c, t, g, unknown or other
  misc_feature (368)..(368): n is a, c, g, or t
  modified_base (438)..(438): a, c, t, g, unknown or other
  misc_feature (438)..(438): n is a, c, g, or t
  modified_base (475)..(475): a, c, t, g, unknown or other
  misc_feature (475)..(475): n is a, c, g, or t
  modified_base (481)..(481): a, c, t, g, unknown or other
  misc_feature (481)..(481): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccgggggggtccctgacactctcctgtgcagcctctggattcacagtcagcagcaatgccatgagttggtccgcaggctcgagggaagggttgcgagtgggtcgtcggggattggaagtgatggtacgccaancactacgctagactcggtgacggggccgcttcatcatcctccagagacgataccgaaacacaggtgatcngacaaatgtacagcctcagcgccgaagcacgggtccntactcngttgacgaaagctctatttcgggcgtcgcgtaaccg

SEQ ID NO: 356523 - DNA, 596 bp, Homo sapiens
  misc_feature: GZ8MTXP01BBKUX.22.36.D03.1.454.CMB.2.raw
  modified_base (224)..(224): a, c, t, g, unknown or other
  misc_feature (224)..(224): n is a, c, g, or t
  modified_base (286)..(286): a, c, t, g, unknown or other
  misc_feature (286)..(286): n is a, c, g, or t
  modified_base (455)..(455): a, c, t, g, unknown or other
  misc_feature (455)..(455): n is a, c, g, or t
  modified_base (470)..(470): a, c, t, g, unknown or other
  misc_feature (470)..(470): n is a, c, g, or t
  modified_base (575)..(575): a, c, t, g, unknown or other
  misc_feature (575)..(575): n is a, c, g, or t
  modified_base (593)..(593): a, c, t, g, unknown or other
  misc_feature (593)..(593): n is a, c, g, or t
  modified_base (595)..(595): a, c, t, g, unknown or other
  misc_feature (595)..(595): n is a, c, g, or t
tcagacatacgcgtcacgaccggtgctcgatttagctgcgtcacgatctctcttggggttttggggggggtccctgacactctcctgtgcagcctctggattcacagtcagcagcaatgccatgagttgggtccgccaggctccgaggggaaggggttgcaggtgggtctcggggattggaagtgatggtgccacacactacgcagactccgtggacggggccncttcatcatctccagagacgattaccgaaaacacagtgaatctagacaaatgtacagcctanacgcgccgaggacaccggccgtctacttcgtagtcgacgtaaacgtccttcgttagttttcgggccgcggaccgtaccgtacggtcggggaccgacgggccctaacccgtcgtcgacccgtctcttcgacgtccctaccaccgacggccctacgtccggtcctccccgnggccctcctacgccnccgagcgccaccgtcgggagacgccacgacggccgccgtaggctcgccgtaggccacggtaactccgttcgacgttcgtagtcgttcgttcggacggcgggtcgnggaccgaggccgtaacgngng

SEQ ID NO: 356524 - DNA, 544 bp, Homo sapiens
  misc_feature: GZ8MTXP01A8OLO.22.36.D03.1.454.CMB.2.raw
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (347)..(347): a, c, t, g, unknown or other
  misc_feature (347)..(347): n is a, c, g, or t
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattggtcttttgactctgtctctggtaccaacaaccacccaggaccaaaccccccatcatcatttanggtntcactcgtccggccctgagcgtctcctcatcgcttcncaggctcagtctgcaacncgccctccctaacntctctcggctccgagtttcgacggtacgagtcttacttattacgtgtactacgtttactttaaagtcggctccgtacttccgttcggttcggtttcggcggtaacggcgaccgaagttcgtaccgtcttcggttcncgccagccncgccccttgtccttcgtccg

SEQ ID NO: 356525 - DNA, 567 bp, Homo sapiens
  misc_feature: GZ8MTXP01ATUFE.22.36.D03.1.454.CMB.2.raw
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (325)..(325): a, c, t, g, unknown or other
  misc_feature (325)..(325): n is a, c, g, or t
  modified_base (329)..(329): a, c, t, g, unknown or other
  misc_feature (329)..(329): n is a, c, g, or t
  modified_base (379)..(379): a, c, t, g, unknown or other
  misc_feature (379)..(379): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaaacaacacccaggccaaaccccccatcatcatttanggtntcactcgtcgccctnaggntctctcatcgcttctcagctccaagtctgcaacacgcctccctaacatcnctgggctaccgagtttgaggacgagtactacttattaccgtggtctacgtttaccctttaaagtacggcgcctacttcgtcggttcggttttcggcgggtaacggtccacggtaaacggttcgacccggttaccgttccggttcacgaacccgaacggctccgccccgttccggtccaaccgttcccg

SEQ ID NO: 356526 - DNA, 575 bp, Homo sapiens
  misc_feature: GZ8MTXP01B49HA.22.36.D03.1.454.CMB.2.raw
  modified_base (218)..(218): a, c, t, g, unknown or other
  misc_feature (218)..(218): n is a, c, g, or t
  modified_base (325)..(325): a, c, t, g, unknown or other
  misc_feature (325)..(325): n is a, c, g, or t
  modified_base (328)..(328): a, c, t, g, unknown or other
  misc_feature (328)..(328): n is a, c, g, or t
  modified_base (344)..(344): a, c, t, g, unknown or other
  misc_feature (344)..(344): n is a, c, g, or t
  modified_base (380)..(380): a, c, t, g, unknown or other
  misc_feature (380)..(380): n is a, c, g, or t
  modified_base (567)..(567): a, c, t, g, unknown or other
  misc_feature (567)..(567): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcactgggtcctgggcccagtctgccctgacccagcctgcctccgtgtctggatcatctggacagtcgatcagcatttccngcactgggaccaacagtgactagttggtctttgactctgtctctgtaccaacaccacccacggaccaaaccccccaatcactctattatgtgtcactcgtcgccctnagntctcctcatcgcttcncacgctcagtctcggacacgacgccctaccctaacnctctcgtcgggctaccgtagtttgacggtacgacgtcttactttacttacgtcgtacttacgtttacctttaaagtacggccgtacctacttcgttcggttacggtttcgggcggtaacggtcgaccggtaagttcggtacccgttcgttcggttcacgcccgaggtcctccgccccgttcggtccncgttcccg

SEQ ID NO: 356527 - DNA, 631 bp, Homo sapiens
  misc_feature: GZ8MTXP01A72X1.22.36.D03.1.454.CMB.2.raw
  modified_base (306)..(306): a, c, t, g, unknown or other
  misc_feature (306)..(306): n is a, c, g, or t
  modified_base (370)..(370): a, c, t, g, unknown or other
  misc_feature (370)..(370): n is a, c, g, or t
  modified_base (376)..(376): a, c, t, g, unknown or other
  misc_feature (376)..(376): n is a, c, g, or t
  modified_base (410)..(410): a, c, t, g, unknown or other
  misc_feature (410)..(410): n is a, c, g, or t
  modified_base (456)..(456): a, c, t, g, unknown or other
  misc_feature (456)..(456): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttgggtacaggcccggggggtccctgacactctcctgtgcagcctctggattcacagtcagcagcaatgccatgagtggccncaggctcgaggggacgggttgcgaggtgggtctcgggggtattggggaagttgaactggggtcncccaanaccacgtacgcaaggtactcggtggacggggccncttcatcatcgaccagacgacgacttaaccggaaacacgaagggtnaaacttccgagaacctaaaagtcgtaacaacggccctacgacggccggaccggtaacggaaccgttacccggggtcccgttacttaaccgtttcgttacggttcggaaccggtaaacgtaccccgttcgtttaacgggttttccggggcccgttcccgggcccggttaacccggg

SEQ ID NO: 356528 - DNA, 572 bp, Homo sapiens
  misc_feature: GZ8MTXP01B40HN.22.36.D03.1.454.CMB.2.raw
  modified_base (191)..(191): a, c, t, g, unknown or other
  misc_feature (191)..(191): n is a, c, g, or t
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (401)..(401): a, c, t, g, unknown or other
  misc_feature (401)..(401): n is a, c, g, or t
  modified_base (455)..(455): a, c, t, g, unknown or other
  misc_feature (455)..(455): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcacatggagtttgggctgaagtggcttttgcttgtggcttaattttaaaaggtgtcaagtgtgnggtgaaggtattggagtcgtgggggagcttggtacgaggccggggggtcctgacactctcctgtgcagcctctggattcacagcagcagcaatgcagtgagttcggccncgaggctcggagggaacgggtncgtaggtggtcgtcgggggattggaaagtgatggtgccanacaactacgnagacgtccgagacggggctctcatcatcncagagacgtactaccaaagcagtgaaattcgaggaactaaagtcgacaacgccncgacgccgacgacggtaccaccgggcctcgtaacttctgttcgaacgaacgttcccttcgttacgttttccgggcccgccgggtcccgtacgttacggtaaccggggcgaacccggg

SEQ ID NO: 356529 - DNA, 699 bp, Homo sapiens
  misc_feature: GZ8MTXP01ESLHV.22.36.D03.1.454.CMB.2.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagngttggtacgagccggggggtcccgtgacactctctgtgcagcctctgattcacagtcagcagacaatgccatggaggttcggggtcccgccgacggtcgtcccggagggggtaaagggggttcggacgtaggggttgggtccgggtgggggtagttagggtaaaggtggtagtcgggtcgacccgacaccaaacgtaccgcgacgtaccgtccgggtcgggacggggtccgtcgttccacttccatacgtccgagaagtacgacgttaaccgaaaacacgagtagtaaactcgtacgggtaactaaagtacggtaccagtcccgacgacggaccggaccggtacggaccggtaccccggtacccgtaacgtttaccgttacgtcgggttagaccggtaaaacgttcccgtttcgtttacggttttcggggccccgtcgggaccccgtacgttaaccgggttcgggaaccgtaacccggggg

SEQ ID NO: 356530 - DNA, 641 bp, Homo sapiens
  misc_feature: GZ8MTXP01B3AK6.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcttgggtacgaggccggggggtccctgaccactctcctgtgcagcctctggattcacagtcagcagcaatgccatgagttggtccgcgaggcgtccgaggggaagggttgcgaggtggtcgtcggggattggaagtgagtggtgccacacaactacgcagacctccggtggacggggccgcttcgatcatctccagacgacgaacgttaccgaaaacacagtagaactcgtacggaactaaagtacgtaacgacgcctacgacggaccgccggaacgggaccgaccgggcccgttaacctaaccgtttcgtcggttacggtaaccggtaaacgttaccgtttccgtttaacggtttttccggggacccggtccgggtacccggtaccggttaccgggttcgggggaacccggtaacccgggg

SEQ ID NO: 356531 - DNA, 583 bp, Homo sapiens
  misc_feature: GZ8MTXP01AXC2C.22.36.D03.1.454.CMB.2.raw
  modified_base (402)..(402): a, c, t, g, unknown or other
  misc_feature (402)..(402): n is a, c, g, or t
  modified_base (444)..(444): a, c, t, g, unknown or other
  misc_feature (444)..(444): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggcccggggggtccctgacactctcctgtgcagcctctggattcacagtcagcagcaatgccatgagttggccgcaggctccgagggaagggttgcgagtgggtctcgggggattgggaagtgagtggtgcccaacgacacgtacgcagactccgtaggacggggccncgttcatcaactcgtaccagacgaccgtactaccgaaaaacncgaaggtagaatcctagaccaaatcgtaacacgcctcgacgccgccggaagtacccgacgggtccttcgtaacgttcttaggttcgaacgaaacgtccgttcgtttacgtttcggggccctaacggggccgtaacccgg

SEQ ID NO: 356532 - DNA, 592 bp, Homo sapiens
  misc_feature: GZ8MTXP01BTW71.22.36.D03.1.454.CMB.2.raw
  modified_base (312)..(312): a, c, t, g, unknown or other
  misc_feature (312)..(312): n is a, c, g, or t
  modified_base (439)..(439): a, c, t, g, unknown or other
  misc_feature (439)..(439): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaaccaacagtgactagttgggtcttttgactctgtctctggtaccaacaacacccaggaccaaaccccccatcatcatttatggtntcactcgtcggccctcagacgtctccctcatcgcttctacaggtcctcaaagtctggacaacacggccctccctaacacttctcgtgggcctaccgtagtttgacggacgagtctacttacttacgngtactagttacctttaaagtcggctacctacgttcttcggtttcgggttttacggcggtaaggtccaccggtaaggttccgtaacccgtcccgttcggttccacgccccgaaagggtcctccgcccccgttacggtccgttaacctttccccg

SEQ ID NO: 356533 - DNA, 616 bp, Homo sapiens
  misc_feature: GZ8MTXP01ETO5H.22.36.D03.1.454.CMB.2.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (329)..(329): a, c, t, g, unknown or other
  misc_feature (329)..(329): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcattttccngacactgggaccaangtgactagtttgggtctttgactctgtctcctggtaccaacaacaccacggaccaaaccccccactcactctatttatggtgtcactcgtcgcctnaggagtctctccatcgcttctcaacgctcgacgtctcggcaacgaccggcctaccctaacactcgtctcgggcctccgtaggtttcgacggtacgtagtaccttacttacttaccgtggtacttaaggtttaccctttaaagttacggtccgtacctacttcgtccgttcgggtttcgggacgggtcggaacgtaacggttacggtcgacccggttccgtccgggttacgccgacccgaacggcccgttccgacccccgttcggttcctaaccgttcgtttccccgg

SEQ ID NO: 356534 - DNA, 722 bp, Homo sapiens
  misc_feature: GZ8MTXP01DUMDH.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaacccaacagtgactattgggttcttttgactctgtctcctggtaaccaacaaccacccacggacccaaaccccccaatcatcatttatgtctcactcgtccgcctcaggagtctcctcatcgtcttctccgaggtcctaccgaaacgttcctacgggaaccctaaaccgaccgggtaccccttacccctaaacctaacttccgtcgtcgggtaccttacccgttaggtttcgaacgggtacgtaacgttaccttaactttaactttacgttacggttactttaaacgttttacccgttttaaaagttacgggtccctacccgttaaacgtttccgtttcgggtttcgggtttttaccggggccgggtaacgggtaccgttaaccgggtaaacggttccggtaaccccggttccgttaccggttcccgaaccggtccccgaaacgggtcccgttccggtccccccgttcgggttcccttaacccgttttccccg

SEQ ID NO: 356535 - DNA, 571 bp, Homo sapiens
  misc_feature: GZ8MTXP01CFUZ9.22.36.D03.1.454.CMB.2.raw
  modified_base (234)..(234): a, c, t, g, unknown or other
  misc_feature (234)..(234): n is a, c, g, or t
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
  modified_base (432)..(432): a, c, t, g, unknown or other
  misc_feature (432)..(432): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacngtgactattgggtctttgactctgtctctgtaccaacaacaccagaccaacccccatcatcatttangtntcactcgtcgcctgagagtctcctcatcgcttcacgagctactaagtctggacaaccgacggcccttaccctaaccactctcgtcggctaccgtagtttgacggtacgtgtaccttattactttacgngtacttacgtttacctttaaatcggcctactacgttcgttcggttcggttttcggcggtaacgtcgaccggtaagttcggtacccgtcttacggttcacggcccagccgtacgccccgttggtaacccttcgttccccg

SEQ ID NO: 356536 - DNA, 617 bp, Homo sapiens
  misc_feature: GZ8MTXP01A4EHF.22.36.D03.1.454.CMB.2.raw
  modified_base (218)..(218): a, c, t, g, unknown or other
  misc_feature (218)..(218): n is a, c, g, or t
  modified_base (258)..(258): a, c, t, g, unknown or other
  misc_feature (258)..(258): n is a, c, g, or t
  modified_base (383)..(383): a, c, t, g, unknown or other
  misc_feature (383)..(383): n is a, c, g, or t
  modified_base (606)..(606): a, c, t, g, unknown or other
  misc_feature (606)..(606): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctattccngcacgtggaaccaacgagtgactagttggtctttgctctnctctagtaaccaacaccaccacgacccaaccccatcatctattatgtctcacgtcgtccgcctgagtctctctctactcgtctcacgacgctaccgagtcacgaccaccgccgtccctaccaacnctcgtcgtcggtctaccgtagttgacggtactacgttacttacttacgttacgtcgttaccgttaacgtttaaccgtttaaagtccggaccgtaccgtacgtttccgttcgggtttcggtttaccgggcggtaacggtaccgttaccggtaaggttcccgtacccgtcgttaccggttccgaccggcccgtaggtccccgtacccgtccccggttacgtcccnccgtttccccg

SEQ ID NO: 356537 - DNA, 611 bp, Homo sapiens
  misc_feature: GZ8MTXP01DYM3K.22.36.D03.1.454.CMB.2.raw
  modified_base (309)..(309): a, c, t, g, unknown or other
  misc_feature (309)..(309): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtctttgactctgtctcctggtaccaaacaacacccacggaccaaaccccccaatcatcatttangtgtcactcgtcgcctcagatctcctcatcgcttctccaggtcctctaagtctggaccaacaccggccctaccctaacctactctcgtcgggtcttaccgtagtttgacggtacgtagtcttaacttacttactcgtactacgtttacctttaaattacggccgtacctacttcgttcggtttcggtttcggcgggtaacggtccgaaccggtaacggttcgtaacccggttccgttacgggttccgacgtaaccccgaaggtcccgtccggtcccccgttcgggtccttaaccgtttcccg

SEQ ID NO: 356538 - DNA, 602 bp, Homo sapiens
  misc_feature: GZ8MTXP01C59ZL.22.36.D03.1.454.CMB.2.raw
  modified_base (322)..(322): a, c, t, g, unknown or other
  misc_feature (322)..(322): n is a, c, g, or t
  modified_base (364)..(364): a, c, t, g, unknown or other
  misc_feature (364)..(364): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctatttaaaaggtgtcaagtgtgcggtgaaggtattggagtcgtgggggagcttggtacaggccggggggtcctgacactctcctgtgcagcctctggattcacagtcagcagcaatgccatgagttgggccgcaggctcgagggagggtncagtgggctcgggggattgggaagtgagtggtacgacccaanacaccgtaacgcaacggacctccggtggacggggccgcttcgatcaactctaccaagacgacgaacttaccgaaaacacgaaggtacggaaatactacgactaaatcgtaacaacgcccgtacaacgccgaccggaacggaaccgaccgggtacccgttccgtaactttccgttaggttcgaccgtaaaacggtacccttcgttaacgttttcggggccccgtcgggcccgtaaccgg

SEQ ID NO: 356539 - DNA, 624 bp, Homo sapiens
  misc_feature: GZ8MTXP01C23AJ.22.36.D03.1.454.CMB.2.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (312)..(312): a, c, t, g, unknown or other
  misc_feature (312)..(312): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (339)..(339): a, c, t, g, unknown or other
  misc_feature (339)..(339): n is a, c, g, or t
  modified_base (616)..(616): a, c, t, g, unknown or other
  misc_feature (616)..(616): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaaccaangtgactagttgggtcttttgactctgtctctacgtaccaaacaaccacccacgacccaaacccccatcatctattanggtntcactcgcgcctnaggctctccncactctcttctacacgtcctaccaaagtctacggacaaaccgccgtaccctaccctaacattccgtcgtcggtccgttacccgttaggtttacggacggtaacgtacgttaccttaaacctttattcgtacggtaactttaacgttttaaccccgtttaaaagttccgggcccttacttaaccgttcggttcgttacgggtttcgggcggtaacgcgttaaaccggtagcgtaccgtccgttcgttcgacgcgaccggtctccgccccgttcgtccncgttcccg

SEQ ID NO: 356540 - DNA, 647 bp, Homo sapiens
  misc_feature: GZ8MTXP01CD92A.22.36.D03.1.454.CMB.2.raw
  modified_base (228)..(228): a, c, t, g, unknown or other
  misc_feature (228)..(228): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtatggagtcgtgggggagcttggtacgnggccggggggtccctgacactctcctgtgcagcctctggattcacagtcagcagcaatgccatgagtggccgcgaggctccgaggggaggggtttgcgtagggttcgggtcgtacgggggtatttaggggaaagttggtagttcggggtacgacccgaacacccgaaacgtaccggcaacggtacccgttcccgggtaggacgggggcccctcttacgacttcactcctacgacgagtaaccgactaaccgaaacacgagtagaactcgtacggaactaaagtcgtaacgacgtccgcgacggaccggaccgacggacccgaccggtcccgtaaccttacgttcgtcgttcgaaccgtaacgttaccgtttcgttacggttttcgggaccgtcggccgtacgacggtcggcgaaccggg

SEQ ID NO: 356541 - DNA, 708 bp, Homo sapiens
  misc_feature: GZ8MTXP01A0EP3.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacagtgactagttgggtcttttgactctgtctctggtaccaacaacacccacggaccaaaccccccactcactctatttatggtctcactcgtcggcctcaggtatctcctcatcgtcttctacgacggtcctaccaaacgttcgtacgggaccaaaccgacccgggtacccctaccccctaaacctacttccgtcgtcggggtccttacccgtagtttcggaacgggtacgtacgttaccttaacgtttaattacgtcgtacgttaacgttttaaccgtttaaagttaccggaccgtacccgtaccttcgtttccgggtttcgggttttccgggacgggtaacggccgttaaccgggtaaacggttccggtaaccccggttcccggttacccgggttcccgaccgggtaaccccgaacgggtccccgttcccgggtccccccggttccgggtaacccttaacccgttttcccccg

SEQ ID NO: 356542 - DNA, 591 bp, Homo sapiens
  misc_feature: GZ8MTXP01A2WSM.22.36.D03.1.454.CMB.2.raw
  modified_base (297)..(297): a, c, t, g, unknown or other
  misc_feature (297)..(297): n is a, c, g, or t
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
  modified_base (340)..(340): a, c, t, g, unknown or other
  misc_feature (340)..(340): n is a, c, g, or t
  modified_base (374)..(374): a, c, t, g, unknown or other
  misc_feature (374)..(374): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctcctgtgcagcctctggattcacagtcagcagcaatgcatgagttggccncagctcgaggagggtncgagtggctgggntggagtcgatggtnccacacaactacgcagacgtcgtagaggggcccnttacagtcattcaccgagagacgattaaccgaaacacagtagaatcgtacggacaaatcgtaacaacgccctgacgaccgaccggacggaaccaccgggcccgtcgtaacttcccgttggacgtaacggtaaacgacccgttcgttaacggttttccgggggcccgtaaccgggtacccgaccgttaccggtccgggggttaacccgtaacccgggg

SEQ ID NO: 356543 - DNA, 586 bp, Homo sapiens
  misc_feature: GZ8MTXP01EQIR1.22.36.D03.1.454.CMB.2.raw
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
  modified_base (368)..(368): a, c, t, g, unknown or other
  misc_feature (368)..(368): n is a, c, g, or t
  modified_base (577)..(577): a, c, t, g, unknown or other
  misc_feature (577)..(577): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgactagttgggtctttgactctgtctcctgtaccaacaacacccagacccaacccccatcatcattangtgtcactcgtcggccctcaggatctcctcatcgcttcncacgctacaaagtctaggaccaacnccggccctaccctaaccactcctcgtcgggtcctaccgtaggtttcgaggtacgtagtctaactttattacgttgtactaacgtttactttaaattacggcctcctacttcgttcggttcggtttccgggcggtaacggccgttacggtaacgttccgtaccgtccttacggttccacgcccgacggtcctcccgccccgttcggtccnccgttcccg

SEQ ID NO: 356544 - DNA, 584 bp, Homo sapiens
  misc_feature: GZ8MTXP01BG5X0.22.36.D03.1.454.CMB.2.raw
  modified_base (278)..(278): a, c, t, g, unknown or other
  misc_feature (278)..(278): n is a, c, g, or t
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
  modified_base (396)..(396): a, c, t, g, unknown or other
  misc_feature (396)..(396): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggcttaattttaaaaggtgtcaagtgtgcggtgaaggtattggagtcgtgggggagcttgggtacgagggccgggggggtccctgacactctcctgtgcagcctctggattcangtcagcagcaatgccatgagttggccncgaggctcgagggagggtncgagtgggtctggggattggaagtgagtggtcgccacacaactacgcagtaccgtccggtggacgggggccncttcatcatctccagacgaacgacttaccgaaacacagtagaatctacgactaaatgtaacagcctcgacgccgacgacggaccgaccggccgtctaacgttcgtagttcgacgaacgttaccgttcgtttacgttttccgggccggtccggtacccggtaccgttaccggtcgggcccgtaaccggg

SEQ ID NO: 356545 - DNA, 686 bp, Homo sapiens
  misc_feature: GZ8MTXP01A7KFZ.22.36.D03.1.454.CMB.2.raw
  modified_base (299)..(299): a, c, t, g, unknown or other
  misc_feature (299)..(299): n is a, c, g, or t
tcagacatacgcgtcacgaccggtgctcgatttagctgcgtcacgatctctcttgggggagagaggagcccaaccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtcctgacactctcctgtgcagcctctggattcacagtcagcagcaatgccatgagtcggccnccaggctccgaggggaagggttgcgtaggtgggtcgcgggggtattgggaagtgagtcggtcgctacacactaacgcaagactccggtggacggggcctcgttcagtcactcctacagacgaacgtaacttaaccgaaaacacgaacgtagtaactacgtacgaacgtaaacgtagtaaccacgtacccgtaccgacggaccggacccggaacggaaccgtacccgggtcccgttaccgttaaccgtttccgttacggttaccggttaaccggtaaaaccggtacccgtttaccgtttaacggtttttcccgggggaaccccggtaccgggtaacccggtaaccggtaccgggttccgggggaacccgttaacggggtaacccccgg

SEQ ID NO: 356546 - DNA, 591 bp, Homo sapiens
  misc_feature: GZ8MTXP01CI7LF.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtatggagtcgtgggggagcttggtacgaggccggggggtcctgacactctcctgtgcagcctctggattcacagtcagcagcaatgccatgagttcgggccgccgaggcctccggagggggtaaaggggttgcgtaggtggggtcgtcgggggtattgggaagtggagtggtacgcccaacacaactacgcagaccgtccggtggacggggccgcttcatcatctaccgagacgacgactaacccgaaacacgaggtagaatctagactaaagtcgaactacgcctacgacgccgccggaacggccgaccggtccgttcgttaacctcgttacgttcgacgtaaacgtccttaacgttagttttcgggccgtccggccgtaaccg

SEQ ID NO: 356547 - DNA, 590 bp, Homo sapiens
  misc_feature: GZ8MTXP01A1QZ0.22.36.D03.1.454.CMB.2.raw
  modified_base (264)..(264): a, c, t, g, unknown or other
  misc_feature (264)..(264): n is a, c, g, or t
  modified_base (466)..(466): a, c, t, g, unknown or other
  misc_feature (466)..(466): n is a, c, g, or t
  modified_base (495)..(495): a, c, t, g, unknown or other
  misc_feature (495)..(495): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggagcttggtacgaggccggggggtcctgacactctcctgtgcagcctcngattcacagtcagcagcaatgccatggagttcgggccgcgaggctcgaagggggaggggttgcgaggtggtcgtagggggattggaagtgagtggtcgactacacgaactaacgcgacgtccgtccgggtagggacggggtccctcttacacgtcactacctaccgaaggacgaacgaacttaaccgaaaactaccgagtanaatctacggaactaaagtcgacacgtccngacgcgcgacgacacgcgtctacttcgtgttcgacgtaacgcgttcgttacgtttccgggccgtccggtccgacgttcggtcgggccgaaccggg

SEQ ID NO: 356548 - DNA, 599 bp, Homo sapiens
  misc_feature: GZ8MTXP01BPV35.22.36.D03.1.454.CMB.2.raw
  modified_base (222)..(222): a, c, t, g, unknown or other
  misc_feature (222)..(222): n is a, c, g, or t
  modified_base (232)..(232): a, c, t, g, unknown or other
  misc_feature (232)..(232): n is a, c, g, or t
  modified_base (253)..(253): a, c, t, g, unknown or other
  misc_feature (253)..(253): n is a, c, g, or t
  modified_base (445)..(445): a, c, t, g, unknown or other
  misc_feature (445)..(445): n is a, c, g, or t
  modified_base (574)..(574): a, c, t, g, unknown or other
  misc_feature (574)..(574): n is a, c, g, or t
  modified_base (592)..(592): a, c, t, g, unknown or other
  misc_feature (592)..(592): n is a, c, g, or t
tcagacatacgcgtcacgaccggtgctcgatttagctgcgtcacgatctctcttggggttttggggggggtccctgacactctcctgtgcagcctctggattcacagtcagcagcaatgccatgagttgggtccgccaggctccgaggggaaggggttgcaggtgggtctcggggattggaagtgatggtgccacacactacgcagactccgtggagggccnttcatcatcncagagacgattaccgaaaacncagtgaatctgacaaatgtacagcctcagcgccgaggacacggccgtctacttctgtcgacgaaacgtccttcgttagttttcgggccggtcggccgtactacggtcggggccaggggccaacccgtggtccacccggtctccttcacgccctccgaccgaacgggcccacgttccggtccctttcccccgngggccccgcccgttcgccctccgaggcgccaccccgtcgggaacgcgccacgacgccggcccgtgggcctcgtcccgtaggtccaacgggaactccgttccgacgttcgtacgtcgttcgttggacggngggccgtgggcacgggcncgaagcg

SEQ ID NO: 356549 - DNA, 590 bp, Homo sapiens
  misc_feature: GZ8MTXP01E303K.22.36.D03.1.454.CMB.2.raw
  modified_base (306)..(306): a, c, t, g, unknown or other
  misc_feature (306)..(306): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactagttgggtctttgactctgtctctgtaccaacaacacccagaccaaaccccccatcatcattatgtntcactcgtcgcctcaggagtctcctcatcgcttctcacggctaccaagtctggaccaacacggccctactacctaaaccatctccgtgggcctccgtagttgaggtacgtagtctattattactgtactacgttacctttaaagttcgggacctcctaccttccgttcggttccgggttttcgggcggtaacggccgtaaccggaagtcgtaacccgttcccgttccgggttccaacggccccgaagggtccctcccggccccccgttccggttccctaacccg

SEQ ID NO: 356550 - DNA, 644 bp, Homo sapiens
  misc_feature: GZ8MTXP01DHL5C.22.36.D03.1.454.CMB.2.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
  modified_base (635)..(635): a, c, t, g, unknown or other
  misc_feature (635)..(635): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctattccngcactggaccaanagtgactagttggtctttgactctgtctctgtaccaacaacacccagaccaaaccccccatcatctattatgtgtcactcgcgcctnagntctcctcactcgtcttcctacgtacggcctactaagtcctacgggacctaaacgccggaccccttacccctaacctacttccgtcgtcgggtacccttaccgtaggtttacggacgggtacgtaacgttacttaaccgtttaactttacggttacgtacgtttaacgtttaacccgttttaaaagtcgggtaccctaccttaacgttccgtttcggtttcgggttttccgggacgggtaacggtccgaacggtaagttccggtaccgttccgttacggttcacgtccgaacgtccgtcccgccccgttcgtccnccgttcccg

SEQ ID NO: 356551 - DNA, 662 bp, Homo sapiens
  misc_feature: GZ8MTXP01CUY2K.22.36.D03.1.454.CMB.2.raw
  modified_base (218)..(218): a, c, t, g, unknown or other
  misc_feature (218)..(218): n is a, c, g, or t
  modified_base (306)..(306): a, c, t, g, unknown or other
  misc_feature (306)..(306): n is a, c, g, or t
  modified_base (324)..(324): a, c, t, g, unknown or other
  misc_feature (324)..(324): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgactattgggtcttttgactctgtctctgtaccaacaacacccacgaccaaacccccatcatcattatgtntcactcgcggcctcaggntctcctcatcgcttctcacggctccaagtctaggacctaacgaccgccctaccctaaaccacttcctcgtcgggcccttaccgtaggttttcgaacgggtaccgtagttaccttaactttaacttacgttcggtacctttaacgtttaccttttaaagttaccggccgtaccctaccgttcgttccggtttcgggttttacgggcgggtaacggtccgaaccggtaaacgttccggtaacccgttcccgttaccgggttccgaacccggtccccggtaaacgggtccccgttcccgggtcccccccgttacgggttaacccttaacccgtttcccccg

SEQ ID NO: 356552 - DNA, 570 bp, Homo sapiens
  misc_feature: GZ8MTXP01D78HY.22.36.D03.1.454.CMB.2.raw
  modified_base (298)..(298): a, c, t, g, unknown or other
  misc_feature (298)..(298): n is a, c, g, or t
  modified_base (307)..(307): a, c, t, g, unknown or other
  misc_feature (307)..(307): n is a, c, g, or t
  modified_base (325)..(325): a, c, t, g, unknown or other
  misc_feature (325)..(325): n is a, c, g, or t
  modified_base (473)..(473): a, c, t, g, unknown or other
  misc_feature (473)..(473): n is a, c, g, or t
  modified_base (530)..(530): a, c, t, g, unknown or other
  misc_feature (530)..(530): n is a, c, g, or t
  modified_base (541)..(541): a, c, t, g, unknown or other
  misc_feature (541)..(541): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgactagttgggtctttgactctgtctcctggtaccaacaccacccacgaccaaaccccccancatctattntgtgtcactcgtcgcctnagactctcctcatcgtcttctaccgagcctacagtctcggacaaccgacgtccctaccctaacctatctcgtacgggtctaccgtagtttcggacgacgtagtacttaacgtttattacgtcgtactacgtttactttaaagtcgtcncctactcgttcgttggtttcgcggtaacgtcgacgtacgttcgccgtcgttcgttcncgccgagtccnccgtccccttcggtccttaacgtttcccg

SEQ ID NO: 356553 - DNA, 796 bp, Homo sapiens
  misc_feature: GZ8MTXP01DRC1O.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagtctatttcctgcacgtacgggaaccaacgagtgactagttgggttctttgactctcgtctccgtacgtaaccaaacaaccaaccccgacggaaccccaaaacccccccaactactacttactattttaatcggtctccaccgttccggtccggtccctacgacggtactccttcctcctactccgtccttcctaaccgacggtcctaccgtaaacggttccgtacggacccaaccgtaccggtaccccttaccctaaacctacttccgtcgtcgggtccttacggtacgggtttacggggaaccgttacgttaccttaactttaacgttacccgttacggggttaaccttttaacggtttttaaaccctttaaaacggttccggtacccgttacccgttaaccgtttccggtttcgggtttacggggtttccggggaccgggtaacgggtaaccctaaccgggttaaaggttcccggttaaccccgttccggtccggttaccgaccggttaccccggtaacgggttccccgtaacccggttcccccccgttcgggttaaccccttcccgtttcccgtttccccccg

SEQ ID NO: 356554 - DNA, 609 bp, Homo sapiens
  misc_feature: GZ8MTXP01CZ0GW.22.36.D03.1.454.CMB.2.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (234)..(234): a, c, t, g, unknown or other
  misc_feature (234)..(234): n is a, c, g, or t
  modified_base (307)..(307): a, c, t, g, unknown or other
  misc_feature (307)..(307): n is a, c, g, or t
  modified_base (323)..(323): a, c, t, g, unknown or other
  misc_feature (323)..(323): n is a, c, g, or t
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (407)..(407): a, c, t, g, unknown or other
  misc_feature (407)..(407): n is a, c, g, or t
  modified_base (508)..(508): a, c, t, g, unknown or other
  misc_feature (508)..(508): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagcatttccngcatgggaccaangtnactagttgggtcttttgactctgtctctagtaaccaaacaaccaccacgaccaaaccccccaatcatcattangtgtcactcgcgcctnaggntcnctcatcgcttctacgaggtcctacctaaagtcgtagggaccaaaccgaccggtaccctaccccttaaacatcctcgngggtcctaccgtagttgaggaccgtatcttaacttattactgtactagtttaccctttaaaagttcggctccgtaacttcgttcggttcgggttttcgggnggaacgggacaacccggtaaagttcggtaacccgtccgttccggttcacgaaccccgaaagtccgtacccggccccttaccggtccgttaacccgttcccg

SEQ ID NO: 356555 - DNA, 662 bp, Homo sapiens
  misc_feature: GZ8MTXP01BDAG6.22.36.D03.1.454.CMB.2.raw
  modified_base (374)..(374): a, c, t, g, unknown or other
  misc_feature (374)..(374): n is a, c, g, or t
  modified_base (597)..(597): a, c, t, g, unknown or other
  misc_feature (597)..(597): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggagcttggtacgaggccggggggtcctgacactctcctgtgcagcctctggattcacagtcagcagcaatgccatggagttcggccgcgaggctccggaggggaagggttgcgaggtgggtcgtcgggggattgggaacgtggacgtggtcgacccaanaccgaaactaccgctaacgacccgtccgggtagggacgggggcccctcgttaccactacgtaactcgtacccgaagaacgtaacgtaacttaacccggaaaactacgaagacgtaatccgtagggaacaaagttcgaacgaacgtccacgacgaccgaccggacggaccacgggcccgtaactccgtttacgtacgttacgaaccgtaaaacgttccccgttntttaccgggtttccgggcccggtccggtaccgaccgttaccgggtccgggttaaccgaacccggg

SEQ ID NO: 356556 - DNA, 718 bp, Homo sapiens
  misc_feature: GZ8MTXP01EJEDU.22.36.D03.1.454.CMB.2.raw
  modified_base (240)..(240): a, c, t, g, unknown or other
  misc_feature (240)..(240): n is a, c, g, or t
  modified_base (322)..(322): a, c, t, g, unknown or other
  misc_feature (322)..(322): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttcctgcacgtagggaaccaacgagtnactagtttgggttcttttgacttctcgtctccgtaggtaaccaaacaaccacccacgacccaaacccccatcatctatttangtctcacgtcgccgccctgaaggctctcctcatcgtcttctacgacgtctacgtaacgtcctacggaccaaccgtacccggtaccccttaaccccgtaaaccctaacgttcccgtccgtccggggtaccctacccgtaacggggtccttcgggaaaccggtaacgttagggtaaaccgggggtttactttaaccggggttttttaacgtcgggtaccttcgggtacccttacgtaatttaacggtcgtaacccggaagggtaaccctaaaacgtttaataaacgtttaacggtttcggggtacccgtttacggggaacgggtaacggaaaccgttaaaacgttccgtaaccggtacgttaacggaccgacgaccgtaacgggttccttaaccccgg

SEQ ID NO: 356557 - DNA, 597 bp, Homo sapiens
  misc_feature: GZ8MTXP01BXL2N.22.36.D03.1.454.CMB.2.raw
  modified_base (362)..(362): a, c, t, g, unknown or other
  misc_feature (362)..(362): n is a, c, g, or t
  modified_base (401)..(401): a, c, t, g, unknown or other
  misc_feature (401)..(401): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtccctgacactctcctgtgcagcctctggattcacagtcagcagcaatgccatgagttggccgcaggctcgagggggagggttgcgaggtgggtctcgggggattgggaagtgatgggtgcccanacaaacctacgcagacccgtcccggtgggacggggcccncttcatcatctccagagacgactaccgaaaacacagtagaatctaggactaaagtcgtaacagccctcgacggccgaccgacggaccgaaccggtcccgtctacgttccgtggttcgacgtaaacgttacccgttcgttacgttttcggggcccggtccgggcccgtacgttaccggtcggggcccgtaaccgggg

SEQ ID NO: 356558 - DNA, 644 bp, Homo sapiens
  misc_feature: GZ8MTXP01CP8I7.22.36.D03.1.454.CMB.2.raw
  modified_base (218)..(218): a, c, t, g, unknown or other
  misc_feature (218)..(218): n is a, c, g, or t
  modified_base (318)..(318): a, c, t, g, unknown or other
  misc_feature (318)..(318): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaacagtgactagtttgggtcttttgactctgtctcctaggtaccaacaaccacccacgaccccaaaccccccatcatactattatgtntcactcgtcgcctgagtactctctccatcgcttctcgaacggtcctccgtaagtccgtacggaccaaccgacccggtccctacccctaaacctactccgttcgtcgggtcctaccgtaggtttacggacggtacgtacgttacttaacgtttacttacgtcggtacgttaacgtttacctttaaaagtcggtccgtcctacgttcgttcggtttcgggtttccggcggtacggtccgaacggttagtccgacccgttccgtcggttaccgaccggcccgtaacggccctaaccgcccccgtggttccctaaccgttccgttccccg

SEQ ID NO: 356559 - DNA, 604 bp, Homo sapiens
  misc_feature: GZ8MTXP01BO9XI.22.36.D03.1.454.CMB.2.raw
  modified_base (319)..(319): a, c, t, g, unknown or other
  misc_feature (319)..(319): n is a, c, g, or t
tcagacatacgcgtcacgaccggtgctcgatttagctgcgtcacgatctctcttggggagctctgagagaggagcccagccctgggatttttcaggttgttttcatttggtgatcaggactgaacagagagaactcaccatggagtttgggctgaagtggcttttgcttgtggcttaattttaaaaggtgtcaagtgtgcggtgaaggtattggagtcgtgggggagcttggtacgaggccggggggtccctgacactctcctgttcagcctctggattcacagtcagcagcaaatgccatggaggtttcggggtcccnccgagggtcctccggaagggggtaacgggggtttgcgtagggttggggtcgtcgggggatttcggggaagtggagtggtcgacccacaacacgtacgcagaccgtccggtaggacggggccgcgttcatcatctaccagacgacgaacttaccgaaacacgagtaggaatctgaacaaatcgtacacgacctcgacgcgccgacggaacgccggccgtcttacgttctcgttcgcgaacgtccttcgttaacgttttcgggcccgttcggtccgcgttaaccggg

SEQ ID NO: 356560 - DNA, 679 bp, Homo sapiens
  misc_feature: GZ8MTXP01BO62X.22.36.D03.1.454.CMB.2.raw
  modified_base (509)..(509): a, c, t, g, unknown or other
  misc_feature (509)..(509): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccatgacactctcctgtgcagccctctggattcacagtcagcagcaatcgccagtggtaggtttcggggtccgccgaggccgtaccggaagggggtaagggggttgacgtagggttcggggtcgtacgggggtattgggaagtgagtggtcgaccacaacactcgacacgaccgtcgtaggacgggggcctcgttcatctactcctaccgagacgtacgtaacttaaccgaaacacgagtacgaactcgtacgtaacaaagtcgtaaccncgaccctcgacggcccgacccgggaaggacccgtaccggtcccgttaccgttaccgtttcgcggtacgtaaccggttaaaaccgttcccgtttacgtttaacggttttcggggccccgggtacccgggtacccggttaccggttaaccgggttccgggggtaaccccggg

SEQ ID NO: 356561 - DNA, 622 bp, Homo sapiens
  misc_feature: GZ8MTXP01BKLVF.22.36.D03.1.454.CMB.2.raw
  modified_base (314)..(314): a, c, t, g, unknown or other
  misc_feature (314)..(314): n is a, c, g, or t
  modified_base (337)..(337): a, c, t, g, unknown or other
  misc_feature (337)..(337): n is a, c, g, or t
  modified_base (348)..(348): a, c, t, g, unknown or other
  misc_feature (348)..(348): n is a, c, g, or t
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagtcgttggtacgacggcccgggggggtccctgacactctcctgtgcagccctctggattcacagtcagcagcaatgccatgagttgggcccncaggcctccgaggggaagggttncgaggtggtcncgggggtattgggaagtgatgggtnccncacactacgcagactccggtgacggggccgcttcatcatctacagacgacgacttaccgaaaacaccaggtacgtaaacgtctagaccaaatcggtaacacggtcctacgaacgccgaccggaagggacccgaaccgggtccccggttacttaaccgttccgttcggttcggacccggtaaaacgttaccccttaacgtttaacgtttttccggggcccggtaaccgggttccccggtaacccggg

SEQ ID NO: 356562 - DNA, 566 bp, Homo sapiens
  misc_feature: GZ8MTXP01BVLLA.22.36.D03.1.454.CMB.2.raw
  modified_base (230)..(230): a, c, t, g, unknown or other
  misc_feature (230)..(230): n is a, c, g, or t
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcagtcaccatctcctgcactggaaccngcagtgacgttggtggttacagtatgtctccgtgtaccaacacccaccaggcacacgcccccaaatcatntatttangagtcacgtagcggcctcgacgggtccccctgatcgtcttctctcggctccagtctcggcgacgcggccctcctcgccgtctcgtcggctccgaggtcgtggaggatcggagtcgtagggtatttacgttaccgtgtctactctatacgtcgcgtacgggtccgtaccgtaacgttcgggttggggttcggttaccgggacggggtacggaccgagttccgtaacgtacccgtcgtacggcaccggcccgaaggtcccg

SEQ ID NO: 356563 - DNA, 594 bp, Homo sapiens
  misc_feature: GZ8MTXP01ELR2P.22.36.D03.1.454.CMB.2.raw
  modified_base (335)..(335): a, c, t, g, unknown or other
  misc_feature (335)..(335): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaaccaacagtgactagttgggtcttttgactctgtctcctgtaaccaaacaaccacccacgacccaaaccccccatcatctatttatgtgtcactcgtcgcctcgagntctcctcatcgtcttctacacggtcctaccaaagtcctggaccaaccgtaccggccctacccctaaccatcctcgtcggtcctccgtaggtttgaggtacgtagtcttacttattaccgtgtacttagttaccttaaagtcggctcctacgttcgtcggtttcggtttcggcggtaacggcgacgtaacgttcgtacccgttccgttcggttcaccgcccgaaggtccctaccgcccccgttcgtccttaaccttcccg

SEQ ID NO: 356564 - DNA, 628 bp, Homo sapiens
  misc_feature: GZ8MTXP01CF4VO.22.36.D03.1.454.CMB.2.raw
  modified_base (307)..(307): a, c, t, g, unknown or other
  misc_feature (307)..(307): n is a, c, g, or t
  modified_base (367)..(367): a, c, t, g, unknown or other
  misc_feature (367)..(367): n is a, c, g, or t
  modified_base (405)..(405): a, c, t, g, unknown or other
  misc_feature (405)..(405): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttgggtacgaggccggggggtccctgacactctcctgtgcagcctctggattcacagtcagcagcaatgccatgagttggccncaggctccgaggggagggtgcgtagtgggtctcgggggattgggaagtgatggtcgcccngacacgtacgcgaagtaccgtccggtggacgggggccncgttcatcagtcctccagacgacgacttaaccggaaaacacgaggtacgaatcgtagaactaaatcgtacgaacgtccgtacacggccgacccggaacggtaacccgttaccgggcccgttaccgttaaccttcggttacggttcggaaccggtaaaacggtaccccgttcgttttaacggttttccgggggaccccgtccggggttaaccccgtaacccggg

SEQ ID NO: 356565 - DNA, 582 bp, Homo sapiens
  misc_feature: GZ8MTXP01C1A0U.22.36.D03.1.454.CMB.2.raw
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (345)..(345): a, c, t, g, unknown or other
  misc_feature (345)..(345): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtctttgactctgtctcctgtaccaacaacacccagaccaaaccccccactcatcatttanggtgtcactcgcggccctnaggngtctcctcatcgcttcncagctcaagtctggcaacaccggccctccctaacactctctcgggctacgtagtttgacggacgtagtactactttattaacgttgtactacgtttactttaaattacggccgtcctactcgttcggttcgggttttcgggcggtaacggcgaaccggtacgttcgtaacccgtccgttcggttccacggtccccgaacggtcctccggtcccccttcggtcccgttaaccttcccg

SEQ ID NO: 356566 - DNA, 673 bp, Homo sapiens
  misc_feature: GZ8MTXP01AIL1B.22.36.D03.1.454.CMB.2.raw
  modified_base (219)..(219): a, c, t, g, unknown or other
  misc_feature (219)..(219): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatcgtggacagtcgatcagcatttccngcactgggacccaacagtgacattgggtcttttgactctgtctcctggtaccaacaaccacccaggaccaaaccccccatcatcatttangtntcactcgtcggccctgaggtatctcctcatcgtcttctacacggtcctaccaagtctcgggaccaaacgaccggccctacccctaaccactcgtcgtgggcctaccgtagtttcgacggtaccgtacgttacttaactttagttaccgttacgtacttaacgtttacccgttttaaaagtcgggtcccgtacccttaaccgttccggttccgggtttcggggttttaccgggcgggttaacggaccgttaacccggtaaacgttccggtaaccccggttcccgttccgggttccacccggaaccccgtaacgggtcccgttcccggtccccccgttacgggtcccttaacccgtttccccg

SEQ ID NO: 356567 - DNA, 626 bp, Homo sapiens
  misc_feature: GZ8MTXP01AZ10W.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtcctgacactctcctgtgcagcctctggattcacagtcagcagcaatgcatgagttggccgcgaggctcgaggggagggttgcgaggtgggtcgtggggattggaagtggagtgggtgacccacacaactacgcaagacctccgggtggacggggccctcgttacacttcactctaccgaggacgaaccgtaacttaacccgaaaacacgtaagtacgaactcgtaggaactaaagtcgtacgaacgccctacgacggccgaccggacggaaccgccggccgtccttacgttcgtcggacgtaacgtaacgttacccgttcgtttacggttttccggggcccgtcccgggtacccgacggttaccggtcgggggcccgtaacccgggg

SEQ ID NO: 356568 - DNA, 530 bp, Homo sapiens
  misc_feature: GZ8MTXP01A3R3W.22.36.D03.1.454.CMB.2.raw
  modified_base (414)..(414): a, c, t, g, unknown or other
  misc_feature (414)..(414): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacgaggccgggggggtccctgacactctcctgtgcagcctctggattcacagtcagcagcaatgccatgagttgggtccgcaggctccgagggaaggggttgcgagtggggtctcgggggattgggagtgatggtgcccaacgacactacgcagactccggtgacggggccgcttcatcatcnccagagacgattaccgaaaacacaggtagaatctagacaaatgtacagcctcagcgcgaaggcacggcgttcgtactcttgttgcgaagctctagtttcgggccgtcgccgtaacg

SEQ ID NO: 356569 - DNA, 643 bp, Homo sapiens
  misc_feature: GZ8MTXP01C0T0P.22.36.D03.1.454.CMB.2.raw
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (236)..(236): a, c, t, g, unknown or other
  misc_feature (236)..(236): n is a, c, g, or t
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcactgggaccaangtnactagttgggttctttgactctgtctctgtaccaacaacacccacggaccaaaccccccaactcatcattatgtgtcactcgcgcctcagngtctccncatcgcttctacacggcctcctaaagtctcgggactaaccgaccgccctaccctaaccactctcgtcgggcctaccgtaggtttcgacggtacgtacgtcttaactttacttacgttcggtacttaacgtttaacctttaaagttacgggccgtcctaacttccgtttcggtttcgggtttccgggcgggttaacgggaccgttaccgggtaaacggttcggtaaccccggttccgttaccgggttccacggaaccccgtaaacggtccgttcccggcccccggttcgggtaaccccttcgtttccccg

SEQ ID NO: 356570 - DNA, 632 bp, Homo sapiens
  misc_feature: GZ8MTXP01BHGFX.22.36.D03.1.454.CMB.2.raw
  modified_base (408)..(408): a, c, t, g, unknown or other
  misc_feature (408)..(408): n is a, c, g, or t
  modified_base (624)..(624): a, c, t, g, unknown or other
  misc_feature (624)..(624): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgactagttgggtcttttgactctgtctctgtaccaacacacccacggaccaaaccccccaatcatctatttatggtgtcactcgtcggccctcaggatctcctcatcgcttctcacgggtcctcctaaagtccgtcggaccaaacgtaccgggtccccttacccctaaaccncttccgtccgtcggggcccttacccgtaggtttcgaacgggtacgtagttaccttaactttacgttacttcggtaaccttacgtttaccttttaaagtacgggtcctacctaccttcgttcggtttcgggttttccgggcggtaacggtccacggtaacgttcgacccgttccgttacgggttcacggcccaggcctccgccccgttcggtaaccncgttcccg

SEQ ID NO: 356571 - DNA, 755 bp, Homo sapiens
  misc_feature: GZ8MTXP01EWINC.22.36.D03.1.454.CMB.2.raw
  modified_base (269)..(269): a, c, t, g, unknown or other
  misc_feature (269)..(269): n is a, c, g, or t
  modified_base (306)..(306): a, c, t, g, unknown or other
  misc_feature (306)..(306): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggcttaattttaaaaggtgtcaagtgtgcggtgaaggtattggagtcgtgggggaggcttggtacgagggcccggggggtccctgacactctcctgtgcagcctntggattcacagtcagcagcaatgccatgagttggccnccgaggcgtcgaggggaaggggttgcgagggttgggtcgtcgggggtatttggggaagtggagtgggtcgacccgacaccgtaaaaccgtcgcgaaacggtacccgtcccgggtagggaccggggggtcccctacgtttaccacttacgtacttacccgtacccgaaaggaacgtaaaccggtacgtttaaacccggaaaaactaccgaaacggtacgtaaaagttcccgttaaggggaacctaaaagttacggttaaaccaaccggttcccctacgaacggacccggacccggaacgggaacccgaccgggtacccgtaaccgtttacctttaccggtaggttacgtaaccggtaaaacgttacccgtttcctttaacgggtttttccggggcccgtaaccggggtcccggtaccgttaccggggttcggggttaaccccggccgggg

SEQ ID NO: 356572 - DNA, 663 bp, Homo sapiens
  misc_feature: GZ8MTXP01C0T5B.22.36.D03.1.454.CMB.2.raw
  modified_base (218)..(218): a, c, t, g, unknown or other
  misc_feature (218)..(218): n is a, c, g, or t
  modified_base (308)..(308): a, c, t, g, unknown or other
  misc_feature (308)..(308): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcaggcacagggtcctgggcccagtctgccctgacccagcctgcctccgtgtctggatcatctggacagtcgatcagctatttccngcacgtgggaaccaacagtgactagttgggttctttgactctgtctctagtacaacaacacccacgaccaacccccatcatcattatgtntctactcgtcgcctcgagagtctcctacatcgtctctcaggcctaccaagtcgtcggacaacaccgtccctaccctaacactctcgtcgggtcctacgtagtttgaccccggtagtacgttacttaacttacttacgtacgtcgttaacgtttaaccgtttaaagttaccggccttacccgtaccgtttccgttccgggtttcggggtttaccggcgggtaaacggtcccgaaaccgggttaaacggttccggtaaccccggttcccggttaccgggttccgaaccggaaccccgtaaacgggtcccgttaccccgggccccccgtttacgggtcccttaaccgttttcccccgg

SEQ ID NO: 356573 - DNA, 701 bp, Homo sapiens
  misc_feature: GZ8MTXP01DO540.22.36.D03.1.454.CMB.2.raw
  modified_base (211)..(211): a, c, t, g, unknown or other
  misc_feature (211)..(211): n is a, c, g, or t
  modified_base (219)..(219): a, c, t, g, unknown or other
  misc_feature (219)..(219): n is a, c, g, or t
  modified_base (237)..(237): a, c, t, g, unknown or other
  misc_feature (237)..(237): n is a, c, g, or t
  modified_base (328)..(328): a, c, t, g, unknown or other
  misc_feature (328)..(328): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (419)..(419): a, c, t, g, unknown or other
  misc_feature (419)..(419): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcganctacttcngacacgtacggaccaagngtcacttagttcggttctttagactctcgtctcgtacgtaaccaaacaccaccgacgaaccccaaacccccatcactctatttagtggtcnctacgtcgccgtcctagacggtntccttcnctacgtctcttcaacgacgtcctactacgtcgtacgaccaacgtccgtccctaccctaacnctctcggcggtctacgttagttaggacgtacgtacgttacttaacttacttcggtacgttacgtttaaaccgttttaaccgtttaaaacgttccggacccgttaccttaaaccgttccgggtttcggttttcggggttaaccgggcggtaacccggacgttaaaccggttacgggttacccgtttacccggtccggtttaccggcgaaaccccggttcccgaaacgggttccccgtccccgggttcccccgttcggtttaaccccttccgttttccccccgg

SEQ ID NO: 356574 - DNA, 702 bp, Homo sapiens
  misc_feature: GZ8MTXP01A1DVV.22.36.D03.1.454.CMB.2.raw
  modified_base (418)..(418): a, c, t, g, unknown or other
  misc_feature (418)..(418): n is a, c, g, or t
tcagacatacgcgtcacgaccggtgctcgatttagctgcgtcacgatctctcttgggggagagaggagcccagcccctgggatttttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcgttggtacgaggccggggggtcctgacactctcctgtgcagcctctggattcacagtcagcagcaatgccagtgaggttcggcccgccgaggcctccggaagggggtaaggggttgcgtagggtgggtcgtcgggggatttgggaagtggagtggtcgcccaacaccaacacgcagacctcgggtaggacggggtccncttacgactcactccgtaccaaggtaacgaaccgtaacttaacccggaaaaccacgtaagtacgaacttacgtacgggaactaaagttcgtaaccgacggtcccacgaccggaccggaccggaacggtacccgaccggtcccgtaaccgtttaacgtttccgtacgggttacgtaaccggtaaaccgttcccgttccgttttacgggtttttcccgggggacccggtcccggggtaccccggtaccggttaacccggggttccgggggcccgtaaccccggggg

SEQ ID NO: 356575 - DNA, 589 bp, Homo sapiens
  misc_feature: GZ8MTXP01BNL77.22.36.D03.1.454.CMB.2.raw
  modified_base (450)..(450): a, c, t, g, unknown or other
  misc_feature (450)..(450): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctcctgtgcagcctctggattcacagtcagcagcaatgccatgagttgggccgccaggctccgaggggagggttgcaggtgggtcgcggggtattggaagtgagtggtcgcccgacacaacctacaacgacgaccgtcccggtggacgggggcctcgttcatcactctaccagacgacgacttaccgaaacacgagtagaatcnggactaaagtgtaccacgtccctacgacgccggcggacggtaccgaccggccggtcctacttcgtcgttacgacgtaacgttccgttcgttacgtttcgggcccgtcggccgtacgttacggtcgggttccgaaccggg

SEQ ID NO: 356576 - DNA, 717 bp, Homo sapiens
  misc_feature: GZ8MTXP01C72P0.22.36.D03.1.454.CMB.2.raw
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctgccctgacccagcctgcctcgtgtctggatcatctggacagtcgatcagctatttccngcacgtgggaaccaacngtgactagttgggtctttgactctgtctccgtacggtaaccaaacaaccaccccgaacggaccccaaaacccccccatccaatcgtaattttagtggtacgtcctaaccgttccggtaccggtccccttagaacgggtacgttcctcctcgtactccgtccttctacgaacggtccttacccgaaaggttcgtacgggaccaaaaccgtcccggtaaccccttaccccttaaaacccgtacgttccgtaccggtcggtaccttacggttaggttacggaacggtaacgttacgttacttaacttaacgttacgtacgttaacgtttaacgtttaaccgtttaaaacgtccgtaccgtaccgttacgttcgttcgggttacgggttccgggacgggtaacgaccgttaacggtacgttccgtacccgttcgttccggcaccgcccgacgtcccgtcccgtccccgttacgtccttccgtccg

SEQ ID NO: 356577 - DNA, 604 bp, Homo sapiens
  misc_feature: GZ8MTXP01DEG3Q.22.36.D03.1.454.CMB.2.raw
  modified_base (407)..(407): a, c, t, g, unknown or other
  misc_feature (407)..(407): n is a, c, g, or t
  modified_base (445)..(445): a, c, t, g, unknown or other
  misc_feature (445)..(445): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggagtcgttggtacgacggcccggggggtcctgacactctcctgtcgcagcctctggacttcacagtcagcagcaatgcatgagtggccacaggctccgagggggtaagggttgcgaggtggtctcgggggtattgggaagtgagtggtcgccaacgacacgtacgcacgactccggtgacgggccnttcatcacgtctaccagacgacgacttaaccgaaaacncaggtacgatactagacaaagtgtaacaacgtccctacgacggcccggccggaaacggcccgaaccgggtcccgttacttaaccgttcgttacggttcgaaccgtaaacggtacccttcgtttacggtttccggggacccgtccgggcccgttaaccgg

SEQ ID NO: 356578 - DNA, 528 bp, Homo sapiens
  misc_feature: GZ8MTXP01C9DPK.22.36.D03.1.454.CMB.2.raw
  modified_base (368)..(368): a, c, t, g, unknown or other
  misc_feature (368)..(368): n is a, c, g, or t
  modified_base (469)..(469): a, c, t, g, unknown or other
  misc_feature (469)..(469): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaaacaacacccaggcaaaccccccaatcatcatttatggtgtcactcgtcggccctcaggagtctcctcatcgcttctcaggctccaaagtctggcaacncggcctccctaaccatctctgggctccagtttgaggacgagtctaacttattactgctagtttacctttaaatttagcgtcctaactctcgtggtttcggnggtaaggcacgagttgaccgtcttcggttcagcccaaggctgccccttgtccaacttcc

SEQ ID NO: 356579 - DNA, 586 bp, Homo sapiens
  misc_feature: GZ8MTXP01BMH8H.22.36.D03.1.454.CMB.2.raw
  modified_base (228)..(228): a, c, t, g, unknown or other
  misc_feature (228)..(228): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcagtcacatctctgcactggaaccngcagtgacgtggtgtacagtatgtctctgtaccaacaccaccagcacacgaccccaaatcatgatttatgagtcacgtacgcggtcctcgacggggtcccctggatcgcttctcgtcgctcaagtctcggccgacgaccggccctacccgtcgacccgtcgtcgtcggactccgaggtcgtaggaggactggacgtcgtaggtaactttacttacgtcgtactacctgtaatacgtgtaccgacgggtccgacgtaacgttccggttgggggttcgttaccggggacggggacggttaccgaacggttccgtcgtaaccccggtcgttaacgggccaaccggtcccgaacggtccccg

SEQ ID NO: 356580 - DNA, 598 bp, Homo sapiens
  misc_feature: GZ8MTXP01AIA6I.22.36.D03.1.454.CMB.2.raw
  modified_base (386)..(386): a, c, t, g, unknown or other
  misc_feature (386)..(386): n is a, c, g, or t
  modified_base (406)..(406): a, c, t, g, unknown or other
  misc_feature (406)..(406): n is a, c, g, or t
  modified_base (557)..(557): a, c, t, g, unknown or other
  misc_feature (557)..(557): n is a, c, g, or t
  modified_base (589)..(589): a, c, t, g, unknown or other
  misc_feature (589)..(589): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgactagttgggtctttgactctgtctctggtaccaacaacacccacggaccaaaccccccactcatctattatgtcgtcacgtcgtcggccctcgaggactctcctcactcgtccttctacacgggtcctccgaaagtctcggaccaacnccggaccctacccctaaacnctctcgtcgggtcctaccgtagtttggacggtacgtacgttaccttaacgttacttaacgtcgtacttacgtttactttaaagtacgggctcctacttcgtcggttggtttcggcggtaagcacgtacgttcgaccgttccgttcggttcncgaacccgacgtccgtccgaccccttcggtcnccgttcccg

SEQ ID NO: 356581 - DNA, 555 bp, Homo sapiens
  misc_feature: GZ8MTXP01DJH2N.22.36.D03.1.454.CMB.2.raw
  modified_base (271)..(271): a, c, t, g, unknown or other
  misc_feature (271)..(271): n is a, c, g, or t
  modified_base (274)..(274): a, c, t, g, unknown or other
  misc_feature (274)..(274): n is a, c, g, or t
  modified_base (279)..(279): a, c, t, g, unknown or other
  misc_feature (279)..(279): n is a, c, g, or t
  modified_base (281)..(281): a, c, t, g, unknown or other
  misc_feature (281)..(281): n is a, c, g, or t
  modified_base (284)..(284): a, c, t, g, unknown or other
  misc_feature (284)..(284): n is a, c, g, or t
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaaggtgtcaagtgtgcggtgaaggtattggagtctgggggagcttggtacagccgggggggtccctgacactctcctgtgcagcctctggattcanagnagcananaangcatgagtggcgcgacgcncgaggagggtgngagtggtgtggagtaggagtgagtggtgcacacaaacacgcagacgtcgtggacgggcgctcatacactctacagaagaacgaactaacgaaaacaacagtaagaatactacgaacaaataacgtaacacgaccacacgacgaccgacggaacgaccgccgtctacttctgttacgacgaaacgaacgttacttacgtttcggtccggccggccgaccgttacgtaacgggccggaacgg

SEQ ID NO: 356582 - DNA, 616 bp, Homo sapiens
  misc_feature: GZ8MTXP01C5CEU.22.36.D03.1.454.CMB.2.raw
  modified_base (219)..(219): a, c, t, g, unknown or other
  misc_feature (219)..(219): n is a, c, g, or t
  modified_base (239)..(239): a, c, t, g, unknown or other
  misc_feature (239)..(239): n is a, c, g, or t
  modified_base (355)..(355): a, c, t, g, unknown or other
  misc_feature (355)..(355): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaaccaacagtnactagttggttctttgactctgtctctcgtaccaacaaccacccacgaccaaacccccactcatctatttatggtctcacgtcgtccgtcctcaggtctctcctcactcgtcttcncacgtctacaagtctcggaccaacgccgtaccctaccctaactacttcgtcgtcgggtccctacgtaggtttacggaacggacgttacgtcttaactttacttacgtcgtacgttaacgtttacctttaaagtcggcctaccgtacgttccgttacgggtttcggtttaccgggcggtaacgaccgttacggtacgttcgtacccgttcgttcggttccacgtcccgaggtccctccgccccgttcgtccttccgttcccg

SEQ ID NO: 356583 - DNA, 690 bp, Homo sapiens
  misc_feature: GZ8MTXP01DNHD0.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctcctgtgcagcctctggattcacagtcagcagcaatgccatgagttggccgcaggctccgaggggaagggttgcgtaggtgggtcgtacgggggtattgggaagtgacgtgggtacgcccaacaccgaaacgttacggcaaggacccgtccgggtagggacgggggtccctcgtttcgactcgactccgtaccgacgacggaacgtaacgttaaccgaaaaccgacgtaacgtacgtaacgtacgtacgggaactaaacgttacgtaaccgacgtcccgtacgacggacccggaccggtaacgggaaccgacccgggtcccggtaaccttacgttcgtcggttacggtaacggtaaacggttaccgttccgtttacggtttttccggggcccggtccggggtacccgtaccggttaccggtcgggggaaccgtaacccggggg

SEQ ID NO: 356584 - DNA, 632 bp, Homo sapiens
  misc_feature: GZ8MTXP01A6QTH.22.36.D03.1.454.CMB.2.raw
  modified_base (267)..(267): a, c, t, g, unknown or other
  misc_feature (267)..(267): n is a, c, g, or t
  modified_base (512)..(512): a, c, t, g, unknown or other
  misc_feature (512)..(512): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttgggtacgaggccgggggggtccctgacactctcctgtgcagcctntggattcacagtcagcagcaatgccagtgagttcgggtcccgccgaggctccgaagggggtaggggttgcgtagggtgggtcgtcgggggtattagggagtggtagtggtcgaccgaacaccaactacgcgacgaccgttccggtaggacggggcctcttcgatcaactcctaccaggtacgaacgtaacttaaccgaaaacgacaagtagaactacgtagaacctaaatacggtaacacgcccncgaagccggaccggaggaccgaccggtccgtaacttacgttctacgttcgacgtaacgttacccgttgtttacggttttcggcccgtcgggccgacgttacggtccgggccgtaaccggg

SEQ ID NO: 356585 - DNA, 690 bp, Homo sapiens
  misc_feature: GZ8MTXP01BXPNE.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagtctatttcctgcacgtgggaaccaacagtgactagttgggtctttgactctgtctctcgtaccaacaaccacccacggacccaaaccccccactcatctattatggtgtcactcgtccggccctcgaggtagtcctccctctactccgtcttctaccgacgggtcctaccgtaaacggtccgtacggaccctaaccgtacccgggtaccccttaaccccctaacctacttcccgttcgttcggggcccttaccggtaaggttttacgaacgggaccgttagttccttaactttaactttcgtagttaccgttaacgttttacctttaaagttacggtccgtacctaccttccgttcggtttacgggttttcgggccgggtaacggtacccgttaaccggtaaagttcggtaccccgttccgttaccgggttcgaccgcccgacggtccctcccgccccgttccgtaacttcccgttcccg

SEQ ID NO: 356586 - DNA, 685 bp, Homo sapiens
  misc_feature: GZ8MTXP01EHP6Z.22.36.D03.1.454.CMB.2.raw
  modified_base (219)..(219): a, c, t, g, unknown or other
  misc_feature (219)..(219): n is a, c, g, or t
  modified_base (231)..(231): a, c, t, g, unknown or other
  misc_feature (231)..(231): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctgccctgacccagcctgcctccgtgtctggatcatctggacagtcgatcagctatttcngcagtggacaangtgactagttggtctttgacttcgtcgtctctacgtaaccaaccaaccacccaccgaaccccaaacccccaacctactactactacttagttgtcgtctcgtcgtccgtccgtcgtacgtacgtcctctctctctctctcgcgtactacgtacgtcgtacgacgaccaccgaccctacctactactctcgtcgtctcgtacgtacgtacgacgtacgtacttacttacgttactacgtacgttacgtttaacgtttaaacgttacgtaccgtaccgttaccgttccgttcggtttcgggtttccggggtaaccgggtaccgggttaccggtaacccggttaaccggttacccggtacccggttacccggttcccggttacccggtaacccggtacccggtaacccggtacccggtccccggttacccccgttccccggttaacccgttaacccg

SEQ ID NO: 356587 - DNA, 668 bp, Homo sapiens
  misc_feature: GZ8MTXP01BRSV1.22.36.D03.1.454.CMB.2.raw
  modified_base (233)..(233): a, c, t, g, unknown or other
  misc_feature (233)..(233): n is a, c, g, or t
  modified_base (576)..(576): a, c, t, g, unknown or other
  misc_feature (576)..(576): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctattcctgcactgggaccaacngtgactagttggtctttgactctgtctcgtcgtaccaacaccaccacgaccaaacccccatcatctatttatgtcgtcactcgtcggcctcgaggtacgtcctacctcacgttccgtcctttaccgcgtaacgggtcccttacccgaaacggttccgtacgggacccaaaccgacccgggtaccccttacccctaaaccctactcccgtcgtcggggtacccttaccggttaagttttgggaacgggtaccgttagtacccttaatttacttacgtgtacgttaacgttttaccctttaaagtacggcctaccgtaacttcgttccggtttgggttttccggngggtaacggccgttaaccggaacggttcgacccgttcgccggttcacggtcccgacgtccgtccgccccgttcggtccttaaccgtttcccg

SEQ ID NO: 356588 - DNA, 813 bp, Homo sapiens
  misc_feature: GZ8MTXP01C1JTH.22.36.D03.1.454.CMB.2.raw
  modified_base (277)..(277): a, c, t, g, unknown or other
  misc_feature (277)..(277): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttaagtttttaaaaggtgtcaagtgtgcggtgaaggtattggagtcgtgggggagtcttggtacgaggccggggggtccctgacactctcctgtcagcctctggntcacagtcagcagcaaatcgcctatggaggttcgggtaccccgccgaggtcctacccgggaaggggggttaagggggtttcggtaagggggttcgggggttcgttacggggggtatttagggggaaacggttggtaacgttggggtaccggccccaaaaccgtaaccaaccgttaaccggacgtaaacggaacccgttccccgggtggggaaacgggggtccccggtccgtttacgaacgttaccgacgtaccttaccccgaaaggtaaccgggtaaaccggtaaacctttaaacccggaaaaaaccaaaccgtaaagggttaacggtaaacttaccggtaacggtaaacctaaaaggttacgtaaccgaccgtaccgtaccgacggtacccgggacccggaacggcccggtaaaccggtcccggttaccgttaaccgttcggttacggtcgaaaccggttaaacgttacccgttaacgttacggttttcggggacccggtccgggacccgttaaccgttccgggtaacccggggg

SEQ ID NO: 356589 - DNA, 605 bp, Homo sapiens
  misc_feature: GZ8MTXP01A4BLA.22.36.D03.1.454.CMB.2.raw
  modified_base (312)..(312): a, c, t, g, unknown or other
  misc_feature (312)..(312): n is a, c, g, or t
  modified_base (375)..(375): a, c, t, g, unknown or other
  misc_feature (375)..(375): n is a, c, g, or t
  modified_base (410)..(410): a, c, t, g, unknown or other
  misc_feature (410)..(410): n is a, c, g, or t
  modified_base (451)..(451): a, c, t, g, unknown or other
  misc_feature (451)..(451): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagtcgttggtacgaggcccgggggggtccctgacactctcctgtgcagcctctggattcacagtcagcagcaatgccatggagtcgggccnccgaggctccggaggggtaagggttgctaggtgggtcgtcgggggattgggaagtgatggtcnccaacacactacgcagaccgtcgaggacggggccncgttcactcattcaccgaagacgacgaactaacccgaaaanaccgaggtagaaactctagaaccaaagtcgtaacgacgcctacgaacgccgaccggaacggacgaccgggtccttctaacgttcgttcggttacgaccgtaaactaccgttcgtttaacgtttccggggaccgtccggttaaccgtaacccggg

SEQ ID NO: 356590 - DNA, 645 bp, Homo sapiens
  misc_feature: GZ8MTXP01EC5EM.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcacccttcctcactcagggcacagggtcctgggcccagtctgccctgacccagcctgcctccgtgtctggatcatctggacagtcgatcagctatttcctgcacgtgggaaccaacgagtgacttagtttgggttacttttgacttctcgtcctccgtagtaacctaaaccaaccaccccacgaccccaaaccccccatcatctatttagtgtctcacgtcgtccgcctgaggtctctcctctatcgtcttcacacgtctacagttcacgaccaacgccgtccctaccctaactcttccgtcgtcggtcttaccgttaggtttcggaacgtacgttacgttccttaactttacttacgtcgttacttaacgttttacgtttaaagtcggcctcctacttcgttcggtttcggtttcgggacggtaacggtaccgacggtacggttccgtacccgttcgttcggttccgaccggccccgtacgggtccctacccgggcccccttaggttccccttccgtttccccg

SEQ ID NO: 356591 - DNA, 602 bp, Homo sapiens
  misc_feature: GZ8MTXP01C60DD.22.36.D03.1.454.CMB.2.raw
  modified_base (190)..(190): a, c, t, g, unknown or other
  misc_feature (190)..(190): n is a, c, g, or t
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
  modified_base (354)..(354): a, c, t, g, unknown or other
  misc_feature (354)..(354): n is a, c, g, or t
  modified_base (396)..(396): a, c, t, g, unknown or other
  misc_feature (396)..(396): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgnggtgaaggtattggagtcgtgggggagcttggtacaggccggggggtccctgacactctcctgtgcagcctctggattcacagtcagcagcaatgccatgagttcggccncaggctccgagggagggttncgaggtggctcgggggattggaagtgaatgggtnccacactaactacgctagaccttcccggtaggacgggggccncgttcactcactctcagagacgacttacgaaaacacagagaatctaggacaaatcgtacgagcctacgacgaccgaccgacggaccgaccggccggttccgtaacgttcccgtggttacggaccgtaaaacgttacccgttctttaacggtttttcgggcccggttccggacccgtaccgttacgttcggggaaccgtaaccgggg

SEQ ID NO: 356592 - DNA, 698 bp, Homo sapiens
  misc_feature: GZ8MTXP01BP4BC.22.36.D03.1.454.CMB.2.raw
  modified_base (575)..(575): a, c, t, g, unknown or other
  misc_feature (575)..(575): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacgagggtcctgggcccagtctcgccctgacccagcctgcctccgtgtctggatcatctggacagtcgatcagctatttcctgcacgtacgggaaccaacgtagtacgacgtagttgggttctttgactctcgtctcctacgtaaccaaacaaccacccaccgaaccccaaacccccatcactactattagtcgtctacacgtcgtccgcctacgacggtactcctacctctactcgtccttcgaccgacgtcctacacgttcgcggaccaaacgcccgtacccctacccgtaacctatccgtcgtcggtaccttacgtagttcggaacgggtactacgttacttacttattacgtacgttaactttaacgtttacctttaaagtccggccttaccgtaaccgtttcggttccgggtttacgggtttacccgggnggtaaccgggtcgttaaacccgggtacgttcccggtaacccggttccgttacccgggttccgaaccgtaaccccggtacggtcccctccccggtcccgttccggtaaccttcccgtttccccg

SEQ ID NO: 356593 - DNA, 545 bp, Homo sapiens
  misc_feature: GZ8MTXP01DUG6Z.22.36.D03.1.454.CMB.2.raw
  modified_base (233)..(233): a, c, t, g, unknown or other
  misc_feature (233)..(233): n is a, c, g, or t
  modified_base (297)..(297): a, c, t, g, unknown or other
  misc_feature (297)..(297): n is a, c, g, or t
  modified_base (301)..(301): a, c, t, g, unknown or other
  misc_feature (301)..(301): n is a, c, g, or t
  modified_base (336)..(336): a, c, t, g, unknown or other
  misc_feature (336)..(336): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgacattgggtctttgactctgtctctgtaccaacacaccagcaaaccccccatcatcattanggtntcactcgtcggcctcaggatctcctcatcgcttcncagctacaagtctcggacaacacggccctaccctaaacactctctcgggctccgtagtttgacgacgagtctattattactgctaagtttccttaaaagttgccgtctactcgtcgttggtttcggcggaacgtcacccggtaagttcgtacccgtccttcggttcgacgtaaccccgaaggcctcgcccccttggtccaaccgttccg

SEQ ID NO: 356594 - DNA, 695 bp, Homo sapiens
  misc_feature: GZ8MTXP01EVHC9.22.36.D03.1.454.CMB.2.raw
  modified_base (220)..(220): a, c, t, g, unknown or other
  misc_feature (220)..(220): n is a, c, g, or t
  modified_base (235)..(235): a, c, t, g, unknown or other
  misc_feature (235)..(235): n is a, c, g, or t
  modified_base (320)..(320): a, c, t, g, unknown or other
  misc_feature (320)..(320): n is a, c, g, or t
  modified_base (334)..(334): a, c, t, g, unknown or other
  misc_feature (334)..(334): n is a, c, g, or t
  modified_base (354)..(354): a, c, t, g, unknown or other
  misc_feature (354)..(354): n is a, c, g, or t
  modified_base (409)..(409): a, c, t, g, unknown or other
  misc_feature (409)..(409): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctgccctgacccagcctgcctccgtgtctggatcatctggacagtcgatcagctatttccngcactgggacccaangtgactagttgggttcttttgacttctgtctctaggtaaccaaacaacacccgacgacccaaacccccccatcatctattatgtntcactcgtcgcctnaggatctcctcatcgcttcncgagcctcgaaagtctacgggacctaacgaccggtacccttacccctaaaccctnttccgtccggttacgggtccttaccccgtagggttttacggacgggttaacgtacgttaccttaaacgttttacttaaaccgggttcgtttaacccgttaaacggttttaacccttttaaaagttaccggggtacccgtaccttaccgtttccggtttacgggttcggggttttaccgggacgggaacgttaccggaaacggttaacgttcggtaacccgttccgttcgggttcaccgtaacccgaagcccgttaccggccccgttagggtccttaaccgttcccg

SEQ ID NO: 356595 - DNA, 654 bp, Homo sapiens
  misc_feature: GZ8MTXP01DGFR1.22.36.D03.1.454.CMB.2.raw
  modified_base (135)..(135): a, c, t, g, unknown or other
  misc_feature (135)..(135): n is a, c, g, or t
  modified_base (193)..(193): a, c, t, g, unknown or other
  misc_feature (193)..(193): n is a, c, g, or t
  modified_base (215)..(215): a, c, t, g, unknown or other
  misc_feature (215)..(215): n is a, c, g, or t
  modified_base (225)..(225): a, c, t, g, unknown or other
  misc_feature (225)..(225): n is a, c, g, or t
  modified_base (257)..(257): a, c, t, g, unknown or other
  misc_feature (257)..(257): n is a, c, g, or t
  modified_base (618)..(618): a, c, t, g, unknown or other
  misc_feature (618)..(618): n is a, c, g, or t
tcagacatacgcgtcacgaccggtgctcgatttagctgcgtcacgatctctcttggggttttggggggggtccctgacactctcctgtgcagcctctggattcacagtcagcagcaatgccatgagttgggtccnccaggctccgaggggaaggggttgcaggtgggtctcggggattgggaagtgatgggtnccacacactacgcagactccgngacggggccnttcatcatctccagagacgattaccgaaaacncagtgaaatctgacaaatgtacagcctcagcgcgagacacggccgtactacttctgtgacgaaagtacctcttagtttttcgggaccgcggaccgtaccgtacgtcggggccgacgggccaaacccgtgtccgaccgtctcttcacgccctacaacccgaacgggtcccacgtcccgggtccttcccccgtggccccgtccccgttcgcccgtacccgacgggaaccccgacccgaaccccgtaccggggacgaccgacccgaaccggtaccggccccggtcccggtcgggtcccgtccggtacccggtacggtacgtaaccggtaaccttaccgttaccgacgttcgttacgtcgttcgnggacggcggtcgcggacgacggcgtaacgaagtaag

SEQ ID NO: 356596 - DNA, 729 bp, Homo sapiens
  misc_feature: GZ8MTXP01C47Y0.22.36.D03.1.454.CMB.2.raw
  modified_base (303)..(303): a, c, t, g, unknown or other
  misc_feature (303)..(303): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaagtatggagtcgtgggggagcttggtacgaggccggggggtcctgacactctcctgtgcagcctcgtggattcacagtcagcagcaatgccagtggagttcgggcccncgaggccgccggaagggggtaaggggttgacgtagggttcgggggtcgtcgggggaatttggggaaagtggtagtgggtcgcctaacaccaaacgtacgcgaacgtaccgtccggtgggacgggggtccctcgttacacttacaacgtcctaccgaaggaacggtaaaccgtaacgtttaaacccgaaaaaacgtaccgaaaggtaggtaaaacttacccgttaggaaaccgtaaaacgttacgggttaaccaaacggtccccttacgaaccgggacccggacccggaaaccgggtaaccgaccccggggtacgttaacccttaacgttcgtacggttacgaaccgtaaacgttacccgtttgtttaacggttttcgggacccggtcggtacccgacggtttacccggcggggcccgtaaccgggg

SEQ ID NO: 356597 - DNA, 587 bp, Homo sapiens
  misc_feature: GZ8MTXP01A0GMO.22.36.D03.1.454.CMB.2.raw
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (301)..(301): a, c, t, g, unknown or other
  misc_feature (301)..(301): n is a, c, g, or t
  modified_base (319)..(319): a, c, t, g, unknown or other
  misc_feature (319)..(319): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (475)..(475): a, c, t, g, unknown or other
  misc_feature (475)..(475): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcatgggaccaanagtgactattgggtctttgactctgtctctgtaccaacaacacccagaccaaacccccatcatcatttangtgtcactcgtcgccctnaggatctcctcatcgcttctcagcctcaagtctgcaacacgcctcccaacntctntcggctcgagtttgaggtacagtactaacttattacgtgtacttagttaccctttaaaagtcggtcctcctaacgttctacggtttcgggttttaccgggnggtaacggtcttaaaccccggtaaaggttccgaaacccggttcccgttacgggttcaccgggaacccctaaaggggccccttcgccccccgttacggtccgaactttccccg

SEQ ID NO: 356598 - DNA, 597 bp, Homo sapiens
  misc_feature: GZ8MTXP01DAZX6.22.36.D03.1.454.CMB.2.raw
  modified_base (218)..(218): a, c, t, g, unknown or other
  misc_feature (218)..(218): n is a, c, g, or t
  modified_base (508)..(508): a, c, t, g, unknown or other
  misc_feature (508)..(508): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgactattgggtcttttgactctgctcctgtaccaacaacacccacgaccaaaccccccatcatctatttatggtgtcacgtcgtccggcccttcgacggatctcctcatcgcttctcagcctaccaaagtctcggaccaacgaccggccctaccctaaccatcctctcgggtcctccgtagtttgacgtacgagttactacttattactcgtactaacgtttaccgtttaaaattcggcctacctaacttcgttcggtttcgggtttccgggngggtaacgccgaaccgtaagttcgtacccggtaccgttcggttcacggcccgaagggcctccggcccccgttcgtccgaacctttcccg

SEQ ID NO: 356599 - DNA, 606 bp, Homo sapiens
  misc_feature: GZ8MTXP01C37B0.22.36.D03.1.454.CMB.2.raw
  modified_base (310)..(310): a, c, t, g, unknown or other
  misc_feature (310)..(310): n is a, c, g, or t
  modified_base (348)..(348): a, c, t, g, unknown or other
  misc_feature (348)..(348): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtctttgactctgtctcctggtaaccaacaaccacccagaccaaaccccccatcatcatttatgtntcactcgtccgccctcaggagtctcctcatcgtcttcncacgtctccaagtctcggaccaacgaccggtccctaccctaacctactcctcgtcgggtcctaccgtagtttacgacggtacgtacgttacttactttacttacgtgtacgttaacgtttacctttaaagttacggccgtacctacttccgttcggtttcgggtttccggcgggtaacggcacggtacgttcgtacccggtccgttcggccacggccccgaaggtcctccggcccccgttcggtccttccgtttcccg

SEQ ID NO: 356600 - DNA, 608 bp, Homo sapiens
  misc_feature: GZ8MTXP01AJPAU.22.36.D03.1.454.CMB.2.raw
  modified_base (304)..(304): a, c, t, g, unknown or other
  misc_feature (304)..(304): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctgtaccaacaacacccacgccaaacccccatcatcattatggtntcactcgtcggcctcaggatcctcctcactcgtcttctcacggctccgaaagtcctggaccaacgaccggtaccccttaccccgtaaccacttcctcgtcgggccttccgagtttcgaggtacgagttcctacgttattcgtgcttagttacctttaagtacgcctacctacttccgttcggttcgggtttccgggacggtaacgggaccgaccggtaagttcccggtaacccggtcccgttcggttccgacggaaccctaacgggccctcccggcccccgttcggttccttaaccgtttcccg

SEQ ID NO: 356601 - DNA, 614 bp, Homo sapiens
  misc_feature: GZ8MTXP01CCR39.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtatggagtcgtgggggaggcttggtacaggccgggggtccctgacactctcctgtgcagcctctggattcacagtcagcagcaatgccatggagttcggtccgccgaggctccgagggaaggggttgcgtaggtgggtcgtcgggggattgggaagtgagttggtgccacacaactacgcagaccgtccggtggacggggccacgtcactcatctccagagacgtacgtacgaaacacagtagaatactagggaactaaagtcgtaacgacgaccctacgacgacggaccgacgggaccgacccggccgttctacgttcgtacgttcgtaacgtaacgttacccgtttcgttaacggtttttcgggcccggtccggtcccgtaccgttaccggtaacggggttcccgaacccgggg

SEQ ID NO: 356602 - DNA, 747 bp, Homo sapiens
  misc_feature: GZ8MTXP01AH58S.22.36.D03.1.454.CMB.2.raw
  modified_base (267)..(267): a, c, t, g, unknown or other
  misc_feature (267)..(267): n is a, c, g, or t
tcagacatacgcgtcacgaccggtgctcgatttagctgcgtcacgatctctcttgggggagagaggagcccagcccctgggatttttcaggtgttttcatttggtgatcaggactgaacagagagaactcaccatggagtttgggctgaagtggtcttttgcttgtggcttaattttaaaaggtgtcaagtgtgcggtgaaggtattggagtcgtgggggaggcttggtacgagggcccgggggggtccctggacactctcctggtncagcctcgtgacttcacagtcagcagcaatcgccagtggtacgttcgggtcccgccgacggccgtaccggagggggtaagggggttgacgtaggtcggggtcgtcgggggtattggaagtgagtggtcgcccacacgaactacgcacgtacccgtcgggtcggaccggggtcctcgtttacactcaactccgtaccgaacggacgtaaaccgtaccgttaaaccgaaaaaccgtaccgtaaagggtaccaagtttactaacggggtaactaaacgttacgttaaacccgacggttaaccctacggaaaccgggtcccggacccgggtaaacggaacccggtaccccgggttcccgttaaccgttaaccgtttccggtacgttacggtaaaccggtaaacgttcccgttttacgttacggttttccgggggacccgttcgggacccgttacggttaccggttcggggcccggtaacccggg

SEQ ID NO: 356603 - DNA, 627 bp, Homo sapiens
  misc_feature: GZ8MTXP01CTDQH.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggctaattttaaaaggtgtcaagtgtgcggtgaaggtattggagtcgtgggggagtcgttgggtacgaggcccggggggtcctgacactctcctgtcgcagcctctggattcacagtcagcagacaatgccagtgtacggtttcgggtcccgaccgaagggccgtaccggagggggtaagggggtgacgtaggtcggggttcgtcggggtagttaggggaagtggagtcggtacgccaacgacacgtacgcgacgcgtacgggtgggacgggccgtcgttcactcaactctacgagacgacgtaactaaccgaaaacacgagtacgaatctagacaagtcgtacacgtctacgacgccgccggaagacgccggtccttcgttaccgttcgttacgttcggaacgtaacgtccgttcgtttacgtttcggggacccgtcgggttaacccgtaaccggg

SEQ ID NO: 356604 - DNA, 626 bp, Homo sapiens
  misc_feature: GZ8MTXP01ARVCR.22.36.D03.1.454.CMB.2.raw
  modified_base (397)..(397): a, c, t, g, unknown or other
  misc_feature (397)..(397): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggctttgcttgtggcttaattttaaaaggtgtcaagtgtgcggtgaaggtattggagtcgtggggaggcttggtacaggccggggggtccatgacactctcctgtgcagtcctcgtggattcacagtcagcagcaatgccagtgagttcggccgcgaggctaccgaggggtaggggttgcgtaggtcgggtcgtcgggggattggggaagtcgagtggtcgccaacaacacctaagcaaggtacccncggtagggacggggtcctcttcgatctaactcgtaccgaagtacgaacgtacgttaaccgaaaacacgaagtagtaaactcgttagaacctaaagtcggtacaacgcctacgacgccgaccgacggaccgacggtcctcttacgtcgttacgtaggtaaccgaacgttccttcgtttaacgtttcggggaacccgtcgggaccgttcgtaacgggttcggggaacccgg

SEQ ID NO: 356605 - DNA, 589 bp, Homo sapiens
  misc_feature: GZ8MTXP01A2O6E.22.36.D03.1.454.CMB.2.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (313)..(313): a, c, t, g, unknown or other
  misc_feature (313)..(313): n is a, c, g, or t
  modified_base (327)..(327): a, c, t, g, unknown or other
  misc_feature (327)..(327): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaaccaanagtgactagttgggtcttttgactctgtctcgtgtaccaacaacacccacgacccaaccccccatcatctattatgtntcactcgtcgcctnaggatctcctcatcgcttctcacgtctccgaagtctcggacaaccgccgtaccctaccctaacactccgtcgtcgggtcctaccgtagtttcggacggtacgtacgttacttactttattacgtgtacttacgtttacctttaaagttacgcgtacctacttcgttacggttcggtttcggcgggtaagccgaacggtagttcgtacccgtcgttccggttcacgtcccgagtccgtccgccccgttcgtccttcgttcccg

SEQ ID NO: 356606 - DNA, 647 bp, Homo sapiens
  misc_feature: GZ8MTXP01C3CNJ.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaacctaacagtgactagttgggtcttttgactctgtctcgtacgtaaccaacaaccacccaacgacccaaacccccccatcactctatttatggtctctacgtccggtaccggccctagaggtactctccctctatcgtcttctacacggtcctacctaaagtccgtacggaccaaccgaccggcccctaccctaaacctctccgtcgtcgggtacctaccgtagtttacgacggtacgtacgttacttaacttattacgtcggtacttaacgtttacttaaagttcgccgttacctacttcgttcggttcgggtttccggcgggtaacggcgttaaccggtagttccggtaccgttccgttcggttcgaccgtcccgacggtcctcccggccccgttacggtccttaaccgtttcccg

SEQ ID NO: 356607 - DNA, 624 bp, Homo sapiens
  misc_feature: GZ8MTXP01BDVCI.22.36.D03.1.454.CMB.2.raw
  modified_base (78)..(78): a, c, t, g, unknown or other
  misc_feature (78)..(78): n is a, c, g, or t
  modified_base (219)..(219): a, c, t, g, unknown or other
  misc_feature (219)..(219): n is a, c, g, or t
  modified_base (322)..(322): a, c, t, g, unknown or other
  misc_feature (322)..(322): n is a, c, g, or t
tcagacatacgcgtcacgaccggtgctcgatttagctgcgtcacgatctctcttggggtggggtctcaggaggcagcnctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaaccaacagtgactagttggttcttttgactctcgtctctacggtaaccaacaaccacccacgacccaaaccccccatcatctatttagtggtntcaccgtcgtccggcctgagcgtctcctcatcgtcttcgtcacggtcctacgaacgtcgtacggaccaaaccgtaccggtacccctaccctaaccgtacttcgtcgtcgggtccttacccgtaggtttacggacggtacgtacgttacttaacttattacgtagtacttacgtttacgtttaaacgtacggccgtacctacttcgtacggttcgggtttcggcggtaacggcgacgtacgttcgtacccgtcgttacggttcacgccacgggtcctccgccccgttcgtccttccgttcccg

SEQ ID NO: 356608 - DNA, 671 bp, Homo sapiens
  misc_feature: GZ8MTXP01B8F7O.22.36.D03.1.454.CMB.2.raw
  modified_base (218)..(218): a, c, t, g, unknown or other
  misc_feature (218)..(218): n is a, c, g, or t
  modified_base (235)..(235): a, c, t, g, unknown or other
  misc_feature (235)..(235): n is a, c, g, or t
  modified_base (308)..(308): a, c, t, g, unknown or other
  misc_feature (308)..(308): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcatcagctatttccngcacgtgggaaccaacngtgactagttgggtctttgactctgtctctgtaccaacaacaccacgaccaaacccccatcatctattatgtntcactcgtcgcctgagacgtctcctcatcgtcttctacgacgtcctactaaagtcctcgggaccaaaccgtccgggaccccttaccctaaactactctcgtcgggtcctaccgtagtttcgacggtacgtagttacttacttattacgtcgtacttaacgtttaccgtttaaaagttccggcctaccttaaccgttccgttcgggtttacgggttttccgggccggtaacggtacccgttaaccgggtaaacgttccggtaaaccccgttccggttacccggttcgaacccggtaaccccgtaaaccgggtcccgttccccgggtccccccgttcgggtaacccttaacccggttttcccccg

SEQ ID NO: 356609 - DNA, 671 bp, Homo sapiens
  misc_feature: GZ8MTXP01D7KBZ.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctgacagtcgatcagctatttcctgcacgtacgggaaccaacgagtgactagttggttctttgactctgtctcgtacgtaaccaacaaccacccgacgaccccaaaccccccaatcactctattagtgtcgtacacgtcgtccggcccttgacggtactcctcctcctacgtccgtctttacctacgacggtcctacctaaacggtccgtacggaccaaccgaccgtacccctaccctaactacgtccgtacgtcggtccttaccgtagtttacgaacggtacgtattacttaacttagtttacgttagttacgtttaactttaaacgttagccgtcctacgttccgttcggtttcgggttccggtacgggacgtaaccgtaacgacggtaccgttaacccggtccgtaccggttccgccgacccggtaacggtccgtcccgtccccggtcgttcctaacccgttccgtttaaccccg

SEQ ID NO: 356610 - DNA, 600 bp, Homo sapiens
  misc_feature: GZ8MTXP01B7CVO.22.36.D03.1.454.CMB.2.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (303)..(303): a, c, t, g, unknown or other
  misc_feature (303)..(303): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacngtgacattgggtcttttgactctgtctctgtaccaacaacacccaggaccaaacccccatcatcatttangtgtcactcgtcggccctgagacgtctcctcatcgtcttctcacggctacaagtctggaccaacgaccggccctaccctaacactccgtcgtcgggcctaccgtagtttcgaaggtcagttctacttacttacgtgacttacgtttaccttaaagttcggcctcctaacttcgtcggttcgggttttcggcgggtaacgtcgttaccggtaacgttcgtaaccgttcccgttacggggttccacggtcccgaacggtccttcccggcccccgttagggtcccttaaccgtttccccg

SEQ ID NO: 356611 - DNA, 609 bp, Homo sapiens
  misc_feature: GZ8MTXP01DJ8ZT.22.36.D03.1.454.CMB.2.raw
  modified_base (304)..(304): a, c, t, g, unknown or other
  misc_feature (304)..(304): n is a, c, g, or t
  modified_base (322)..(322): a, c, t, g, unknown or other
  misc_feature (322)..(322): n is a, c, g, or t
  modified_base (390)..(390): a, c, t, g, unknown or other
  misc_feature (390)..(390): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcttggtacgaggccgggggggtccctgaccactctcctgtgcagcctctggattcacagtcagcagcaatgccatgagttggccncagctccgagggagggtncaggtggctgggggattggaagtgatggtcgccacacaactacgcacgacctccggtggacggggccnctcatcatctccagagacgattaccgaaacacaagtgaactctaggaacaaatacgtaacacgccctcgacggaccgccggaacggaccgaccgggtcccgttaaccttactttcgtacggttacggaacgtaaacgttacccgtttcgttacggttttttccggggcccggtcccgggtcccggaccgttaccgggtccgggggcccggtaaccgggg

SEQ ID NO: 356612 - DNA, 622 bp, Homo sapiens
  misc_feature: GZ8MTXP01A0MBF.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtcctgacactctcctgtgcagcctctggattcacagtcagcagcaatgcatgagttggccgcagctccgaggggagggttgcgaggtggtccgtggggattggaagtgagtggtgccacacaactacgcacgacctccggtggacggggcctcttcactcatcgtcagagacgaacttaccgaaaactacagtagactactagacgtaaaacgtgtaaaccgacggtccctacgaccggaccggacccggaagggtacccgaaccgggtcccgttaaccgttaacgttcgtcggttacgaaccggtaaaacttcccgttacgtttaacggtttttcggggccccgtccgggtcccgaccgttacggtccggggccgtaaccgggg

SEQ ID NO: 356613 - DNA, 686 bp, Homo sapiens
  misc_feature: GZ8MTXP01COB8X.22.36.D03.1.454.CMB.2.raw
  modified_base (222)..(222): a, c, t, g, unknown or other
  misc_feature (222)..(222): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctcgccctgacccagcctgcctcgtgtctggatcatctggacagtcgatcagtctactttccngcacgtacgggaaccaacgtagtgacttagtttgggttctttggacttctcgtcctaccgtacggtaaccaaacaaccacccgaacgaccccaaacccccatcatctactttgtacggtctctaccgttcggccgtcctacgacggtacttcctaccctctacgttcgtcctttacaaccgtacggtccctacggtaaacgttccggacggaccaaaccgtccgtaccccttaccctaaacctctcctcgtacggtcctacgtacggtttacgacggtacgtacgttacttacgtttacttacgtcgttaacgtttacgtttacgtttaaagtcggaccttctacgtcgtttcgggttacggtttcggacggtaacgtaccgttacgtacgcgtaccccgtcgttcggttcacggtaacccgacgtccgtacccgtccccgttacgtccttaaccgtttccccg

SEQ ID NO: 356614 - DNA, 626 bp, Homo sapiens
  misc_feature: GZ8MTXP01EBP0Q.22.36.D03.1.454.CMB.2.raw
  modified_base (219)..(219): a, c, t, g, unknown or other
  misc_feature (219)..(219): n is a, c, g, or t
  modified_base (311)..(311): a, c, t, g, unknown or other
  misc_feature (311)..(311): n is a, c, g, or t
  modified_base (326)..(326): a, c, t, g, unknown or other
  misc_feature (326)..(326): n is a, c, g, or t
  modified_base (329)..(329): a, c, t, g, unknown or other
  misc_feature (329)..(329): n is a, c, g, or t
  modified_base (345)..(345): a, c, t, g, unknown or other
  misc_feature (345)..(345): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcagtgggaccaacagtgactagtttgggtctttgactctgtctctgtaccaacaaccaccacgacccaaaccccccatcatctattatgtntcactcgtcgcctanagntctctcatcgtcttcncgtaacgtcctccgaagtccgtacgggaccaaaccgacccgggtaccctacccctaaaccacgttccgtcgtacgggtcctaccgttaggtttgaacggtctagttaccttacttatttaccagggtactttaacgtttacctttaaagtcggcccttcctaccgttcgttcgggttggtttccggacggaggtaactacccggttaagtccgttaccgttcgacgttacgacgttcccgaaggtcctaacgtcccctgttacctccgttctttaaccccg

SEQ ID NO: 356615 - DNA, 646 bp, Homo sapiens
  misc_feature: GZ8MTXP01CYAYX.22.36.D03.1.454.CMB.2.raw
  modified_base (313)..(313): a, c, t, g, unknown or other
  misc_feature (313)..(313): n is a, c, g, or t
  modified_base (326)..(326): a, c, t, g, unknown or other
  misc_feature (326)..(326): n is a, c, g, or t
  modified_base (345)..(345): a, c, t, g, unknown or other
  misc_feature (345)..(345): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaaccaacgagtgactagttgggtcttttgactctgtctctgtaccaacaacacccaggaccaaaccccccatcatcatttatgtntcactcgcgcctnagatctcctcatcgcttcncacgcctacaaagtctcggaccaaccgaccggcccctacccctaacctactcgtcgtacgggcctaccgtagtttacggacggacgtacgtcttaactttacttacgtcgtacgttaacgtttacctttaaagttacggccgtaccttaccgttcgttaccgggtttcgggttttaccggcgggtaacggtccgaaaccgggtacgttccggtaaccccggttccgttaccgggttccaccggtaaccccgtaaaggtccccgttccggacccccgtttcggtcccttaaccgtttccccg

SEQ ID NO: 356616 - DNA, 711 bp, Homo sapiens
  misc_feature: GZ8MTXP01ED2L7.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtggggagcttggtacaggccggggggtcctgacactctcctgtgcagcctctggattcacagtcagcagcaatcgccatcggagttcggccccgccgaggccgttaccggaagggggtaagggggttcgacgtagggttgggtcgtacgggggtattgggaaagtgaacgtgggtacgccctaacgaccgtaacctaaccggcgaaaccggtaccgttcccgggtagggaccggggggccctcgtttaccacttaccacgttcacccgagaacgaacgtacttaaaccgaaacacgaagtacgaaatctacggacaaagtcgtaacacgtccacgacgaccggaccgacgggaccgacccgggtcccggttaacttccgttacgttcggttacggaaccgtaaaaccggttcccgtttacggtttaaccgggtttttccggggaccccggtccggaccccgggtaccgttaccgggttaaccggggaaccggtaacccgggg

SEQ ID NO: 356617 - DNA, 589 bp, Homo sapiens
  misc_feature: GZ8MTXP01BQOG5.22.36.D03.1.454.CMB.2.raw
  modified_base (322)..(322): a, c, t, g, unknown or other
  misc_feature (322)..(322): n is a, c, g, or t
  modified_base (363)..(363): a, c, t, g, unknown or other
  misc_feature (363)..(363): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacagtgactagttgggtctttgactctgtctctgtaccaacacacccagccaaacccccatcatctatttatgtgtcactcgtcggccctnaggatctcctcatcgcttctcagctccaagtctcggcaacncgccctaccctaacactctcgtcgggcttaccgtagtttgacgggtacgacgtacttaactttacgttacgtcgtacttaacgtttacctttaaagttacggcgtacctacttccgtcggttcggttttcggcgggtaagtccgaccggtaacgttcgtaccgtccgttcggttcaccggtcccaacggtcctccggtcccccgttacggtccgttaaccttcccg

SEQ ID NO: 356618 - DNA, 720 bp, Homo sapiens
  misc_feature: GZ8MTXP01A75NF.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaaccaacagtgactagttgggtctttgactctgtctctagtaccaacaacacccacgacccaaaccccccatcactctatttatggtctcacgtccggtccggcccttcgacggtactctacctcactccgtccttcctacgacgtccttaccgaaacgttccgtacggacccaaccgacccgggtacccttacccctaacctacttccgttcgtccggggtacccttacccgttaaggttttacggaacgggtaccgtaacgttccgtttaaactttaacgtttaccgtacggttaccttaacgttttaacccttttaaaagttcggtcccgtaccgttaccgttccgtttccgggtttacggggttttcccgggacgggtaacggtaccgttaaccgggtaaagttccggtaacccggtccgttaccggttccgaccgcccggaacggtccctcccgggtcccccttcgggtaacccttccgtttccccg

SEQ ID NO: 356619 - DNA, 651 bp, Homo sapiens
  misc_feature: GZ8MTXP01D060Y.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtccctgacactctcctgtgcagcctctggattcacagtcagcagcaatgccatgagttggccgcaggctccggaggggaagggttgcgtagggtgggtcgtcgggggattggaagtgagtggtcgccacgacaaccgtacgcgagacccgtccgggtaggacgggggtcctcgttacactcgtactccgtaccgagacgaacgtaacttaaccgaaaacacgtaagtagaaattccgttagggaacctaaaagttcggtaaaccaacgttccccgtacgacggacccggaccggtaaccggaccgtacccggtcccgtcttaaccgttcgtacgttacgtaacgtaaacgttaccgttcgtttacggttttcgggcccggtcggccgtacgttacggtccgggccgtaaccggg

SEQ ID NO: 356620 - DNA, 576 bp, Homo sapiens
  misc_feature: GZ8MTXP01AH8CY.22.36.D03.1.454.CMB.2.raw
  modified_base (322)..(322): a, c, t, g, unknown or other
  misc_feature (322)..(322): n is a, c, g, or t
  modified_base (331)..(331): a, c, t, g, unknown or other
  misc_feature (331)..(331): n is a, c, g, or t
  modified_base (362)..(362): a, c, t, g, unknown or other
  misc_feature (362)..(362): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctcctgtaccaacaacacccagaccaaaccccccatcatcattatgtgtcactcgtcgccctnagagtctcncatcgcttctcaggctcaagtctggctaacncgccctaccctaacactctcgtcgggctccgtagtttgacggtacgacgtcttactttattaacgtgttacgtttacctttaaacgttaaaggtccgtctaccttcgtcgttggtttcggcggcggcaaccggacggtacgacccgtaccgttcggcgttcgacccgaacgggtccgtccgtcccccgttccgttaccgtccgttcgttccccg

SEQ ID NO: 356621 - DNA, 648 bp, Homo sapiens
  misc_feature: GZ8MTXP01A2JCB.22.36.D03.1.454.CMB.2.raw
  modified_base (221)..(221): a, c, t, g, unknown or other
  misc_feature (221)..(221): n is a, c, g, or t
  modified_base (333)..(333): a, c, t, g, unknown or other
  misc_feature (333)..(333): n is a, c, g, or t
  modified_base (336)..(336): a, c, t, g, unknown or other
  misc_feature (336)..(336): n is a, c, g, or t
  modified_base (366)..(366): a, c, t, g, unknown or other
  misc_feature (366)..(366): n is a, c, g, or t
  modified_base (380)..(380): a, c, t, g, unknown or other
  misc_feature (380)..(380): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacgagggtcctgggccccagtctgccctgacccagcctgccctccgtgtctggatcatctggacagtcgatcagctatttccngcactgggaccaacagtgactatttgggtcttttgacttctgtctcctggtaccaacaaccacccgacgaccaaaccccccatcatctattatgtgtcactcgcgcctgagntcnctcatcgtctctcaagctcagtctggcacncgcctaccctaccntctcgtcggctccgtagtttcgacggacgtacgtacttactttattaccgtgggtacttaacggtttacctttaaagttacggtacccgtcccgtaaccgttccgtttccggtttcggggtttttacgggccggggtaagggtaacccgaaccgggttaaaccggtccggttaccccggttccggtttccgggttccgttaccggccccgtaaagggccccgttcccggccccccgttcccggttccgtaacccttcgtttcccccgg

SEQ ID NO: 356622 - DNA, 587 bp, Homo sapiens
  misc_feature: GZ8MTXP01EY78C.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggcccgggggggtccctgacactctcctgtgcagcctctggattcacagtcagcagcaatgccatgagttcgggtccgccaggctccggaggggaaggggttgcgaggtgggtcgtcggggtattgggaagtgagtggtacgccaacacactacgcacgacgtccggtggacggggccgtcgttcacgtcactaccgtaccagacgacgtaacgttaaccgaaaacacaaggtacgaatctagaactaaatcgtaacgacgcctacgacgccggccggaaggaccgacgggcccttcgtacttcttcggttcgacgaaacgtctcgttacgtttcgggccgtcggccgtaacg

SEQ ID NO: 356623 - DNA, 638 bp, Homo sapiens
  misc_feature: GZ8MTXP01BJ1N9.22.36.D03.1.454.CMB.2.raw
  modified_base (130)..(130): a, c, t, g, unknown or other
  misc_feature (130)..(130): n is a, c, g, or t
  modified_base (322)..(322): a, c, t, g, unknown or other
  misc_feature (322)..(322): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctnactcagggcacagggtcctgggcccagtctgccctgacccagcctgcctccgtgtctggatcatctggacagtcgatcagctatttcctgcactgggaccaacagtgactagttgggttctttgactctgtctcctagtaccaacaaccacccaacggtccaaacccccccaatccaactctatttatggtntcacctcgtccggcctcaggactctcctcatcgcttctcagctccaacgtctcggacaacgaccgtcctaccctaacactctcgtcgggcttaccgaggtttagacggtacgtagtacttaacttacttactggtacttaacgtttacccgtttaaatacggtccgaccttacgttcttcggttcggttttccgggcggtaacggtcgttaccggtaaacggttccgtaaacccggttccgttaccggttccaaccggcccgtaaagggtccccgtaccgtcccccccgttcgggtccccttaaccggtttccccg

SEQ ID NO: 356624 - DNA, 680 bp, Homo sapiens
  misc_feature: GZ8MTXP01BO9V4.22.36.D03.1.454.CMB.2.raw
  modified_base (270)..(270): a, c, t, g, unknown or other
  misc_feature (270)..(270): n is a, c, g, or t
  modified_base (276)..(276): a, c, t, g, unknown or other
  misc_feature (276)..(276): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggcttattttaaaaggtgtcaagtgtgcggtgaaggtattggagtcgtgggggaggtcgttggtacgaggcccgggggggtccctgacactctctgtgcngcctcnggattcacagtcagcagcaatcgccatggacggtttcggggtacccgccgacgggccttaccggaagggggtaagggggttgcgtagggtcggggtacgtcgggggatttagggagtggagtggtacgccaacgacaacgtcgacaacgtcctcggtggacggggccgtacttcactacgtaactccgtaccgaagtacggaaccgtaaaccgttaaacccgaaaaaccgtaaccgtaagggtaacgtaaacgttaccgtaagtaacctaaagtcggtaaacaaccggtccctacgaacggccgcccggaaggacccgaaccggtcccgttcctaacgttcttggttccgacgtaaacgtccgttaacgttacggtttcgggacccggtccggccgtaacccgg

SEQ ID NO: 356625 - DNA, 688 bp, Homo sapiens
  misc_feature: GZ8MTXP01D415V.22.36.D03.1.454.CMB.2.raw
  modified_base (235)..(235): a, c, t, g, unknown or other
  misc_feature (235)..(235): n is a, c, g, or t
  modified_base (310)..(310): a, c, t, g, unknown or other
  misc_feature (310)..(310): n is a, c, g, or t
  modified_base (313)..(313): a, c, t, g, unknown or other
  misc_feature (313)..(313): n is a, c, g, or t
  modified_base (331)..(331): a, c, t, g, unknown or other
  misc_feature (331)..(331): n is a, c, g, or t
  modified_base (337)..(337): a, c, t, g, unknown or other
  misc_feature (337)..(337): n is a, c, g, or t
  modified_base (339)..(339): a, c, t, g, unknown or other
  misc_feature (339)..(339): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaaccaangtgactattgggtctttgactctgtctccgtgtaaccaaacaaccaccacggaccaaacccccatcatcatttangtntcactcgtcgcctcaggntctccncntccgcttctcacggtcctaccgaaagtcctacggaccaacacccgggtaccctacccctaaacctatcctcggtcggtcctaccgtagtttcgacggtacgtattacttaactttacttacggtacgtacgtttaacgtttacctttaaaacgttcgggccctacccttaacgttccggtttccgggttcgggttttacccggggcggttaacggggccccgttaaacgggaaccggtttccgtaaaccccggttcccggttaccgggttccaaaccgggtaaccccggtaaacggccccgtttaccgggaccccccgtttccgggttccttaaccccggttttccccg

SEQ ID NO: 356626 - DNA, 660 bp, Homo sapiens
  misc_feature: GZ8MTXP01BLEJ6.22.36.D03.1.454.CMB.2.raw
  modified_base (396)..(396): a, c, t, g, unknown or other
  misc_feature (396)..(396): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatgccatgagttggccacgaggctcgaggggaagggttgcgaggtgggtcgtgggggattggaagtgagtggtcaccacacaactacgcgagaccgtccggtggacgggggccncttcgatcagtcctcgaagacgaacgtacttaaccgaaaacacaagtacgaattccgaggaactaaagtacggtaaccaggccctacgacggacccggaccggaacgggtacccgtaccgggtccccgttaacttaaacccgtttcggtacggttacggaaaccggtaaaacgttaccccgtttcgttttaacggtttttccggggcccggtaaccgggtaccccggtacgttacccgggttcgggggaaccccgtaaccgggg

SEQ ID NO: 356627 - DNA, 630 bp, Homo sapiens
  misc_feature: GZ8MTXP01CS7L0.22.36.D03.1.454.CMB.2.raw
  modified_base (321)..(321): a, c, t, g, unknown or other
  misc_feature (321)..(321): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactcggggaaccaacgagtgactagtttgggtcttttgactctgtctcgtcgtaccaacaaccacccacgaccccaaacccccatcatctatttagtgtntcacttcgccggcctgaggtactctcctcacgtcgtcttctacacgtcctacctaaacgtcgtacggaccaaccgacccggaccccttacccctaacctacttcccgtacggtcggtccttacgttcggtttaggacggtacgtacgtacttactttacgtacttgtactttactttaaccgtttaaagtacgccgtaccgtactttcgttcggtttgggtttccggacggtaacggtacgacggtaacgttcgtacccgtccgttacggttcacgccgacgtcctcccgcccgttcgtcgccgttccc

SEQ ID NO: 356628 - DNA, 609 bp, Homo sapiens
  misc_feature: GZ8MTXP01ELZC7.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatgccatgagtggccgcaggctcgagggagggttgcgaggtggtcgtcggggattgggaagtgagtggtgaccactacaaacctacgcgagacccgtccggtggacgggggccctcttacactcactctcccgaagacgaacgaacttaaccgaaaacaacagtagaatcctaggactaaagtcgtaacacgcctacgacgaccggaccgtacggaccgacccggtccgtcgttaaccgtttcgtcgttacgacgtaaacgttccgtttcgttacggttttcgggcccgtcggcccgtaccgttcggtaacggggcccgtaaccggg

SEQ ID NO: 356629 - DNA, 673 bp, Homo sapiens
  misc_feature: GZ8MTXP01A2AOG.22.36.D03.1.454.CMB.2.raw
  modified_base (316)..(316): a, c, t, g, unknown or other
  misc_feature (316)..(316): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaaccaacgagtgactagttgggttctttgactctgtctctaggtaccaacaacacccacgacccaaacccccatcactcatttatgtntcactcgtccgcctgaggctctctcatcgcttctacgacgtctaccgtaagtctacggaccaaccgtaccgtcccctaccctaaccacttcctcgtcgggtcctaccgtagtttacggacggacgtagttacttagtttacttacgtcgtacttaacgtttaccctttaaagtccgcgtaccctacgtttccgttacgggtttcggtttccgggcggtaacggtccgttaaaccgggtacggttaccggtaacccggttcccgttaccggggttcccaaccgggtaaccccggtaaacggtcccgttccccggtcccccccggttacgggttaaccccttaacccggttttcccccg

SEQ ID NO: 356630 - DNA, 624 bp, Homo sapiens
  misc_feature: GZ8MTXP01C81PA.22.36.D03.1.454.CMB.2.raw
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (298)..(298): a, c, t, g, unknown or other
  misc_feature (298)..(298): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctcgccctgacccagcctgcctcgtgtctggatcatctggacagtcgatcagctatttccngcacgtggaaccaagngtgactgttggtctttgctctgtctctacgtaaccaacaaccaccacgacccaaacccccancatctattatgtctcacgtcgtaccgcctacgaggtactcctcctactacgtcgtccttacgactacggtcctactaacggtctacggacctaaccgaccgtcccctaaccctactactccgtacgtcggtacctccgtagttcggacgtactacgttactactttatccgtagtactttagtttaaccttaagttacgcctacttacgttccgttcgggttcgggtttcggcggcgtccgacggtaacgttcggttaccccgtcgttccggttcgaccgtaacccgacgtccgttccccgcccgttaccgtccgttaacctcccg

SEQ ID NO: 356631 - DNA, 576 bp, Homo sapiens
  misc_feature: GZ8MTXP01DYW4I.22.36.D03.1.454.CMB.2.raw
  modified_base (271)..(271): a, c, t, g, unknown or other
  misc_feature (271)..(271): n is a, c, g, or t
  modified_base (367)..(367): a, c, t, g, unknown or other
  misc_feature (367)..(367): n is a, c, g, or t
  modified_base (398)..(398): a, c, t, g, unknown or other
  misc_feature (398)..(398): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtcctgacactctctgtgcagcctctggattcacngtcagcagcaatgccatgagttgggtcccgccgaggctccgaggggaaggggttgcgaggtgggtcgtcgggggatttggaagtgagtggtgccanacaaactacgcagacctcggtgacggggccnttcatcatcctcagacgaacgtacttaaccgaaaacacgagtagaaactcgtaggaactaaatcgtaacacgctcgacggcgccgaggcaaccggctcgtacttgcgttagaccgtaaagttaccttcgtttaggttttcgggcccgtcggtccgacttacggtcgggccgaaccggg

SEQ ID NO: 356632 - DNA, 589 bp, Homo sapiens
  misc_feature: GZ8MTXP01ARMTZ.22.36.D03.1.454.CMB.2.raw
  modified_base (227)..(227): a, c, t, g, unknown or other
  misc_feature (227)..(227): n is a, c, g, or t
  modified_base (259)..(259): a, c, t, g, unknown or other
  misc_feature (259)..(259): n is a, c, g, or t
  modified_base (299)..(299): a, c, t, g, unknown or other
  misc_feature (299)..(299): n is a, c, g, or t
  modified_base (438)..(438): a, c, t, g, unknown or other
  misc_feature (438)..(438): n is a, c, g, or t
  modified_base (567)..(567): a, c, t, g, unknown or other
  misc_feature (567)..(567): n is a, c, g, or t
  modified_base (588)..(588): a, c, t, g, unknown or other
  misc_feature (588)..(588): n is a, c, g, or t
tcagacatacgcgtcacgaccggtgctcgatttagctgcgtcacgatctctcttggggttttggggggggtccctgacactctcctgtgcagcctctggattcacagtcagcagcaatgccatgagttgggtccgccaggctccgaggggaaggggttgcaggtgggtctcggggattgggaagtgatggtgccacacactacgcagacctccggtggacggggccncttcatcatctcagagacgattaccgaaaacncagtgaatctgacaaatgtacagcctcagcgccgaggacncggccgtctacttctgtcgacgaaagaccctcttacgttttcgggccgcggtccgacctacggtggggcccagggccaacccgtcggtccaccgtctcttcgacgcctccaccgacgggcccagtccgtccttccccgnggccgccctgcctcgagcgactaccgcgggagcgcgaccacggcccggcccgtgggcctcggtccgtcggtaaccgaacgggaaccttaccttccgaacgttcgtagtcgttccgttggacggcgggtncgggacgacggccgcttaagng

SEQ ID NO: 356633 - DNA, 622 bp, Homo sapiens
  misc_feature: GZ8MTXP01AUGCO.22.36.D03.1.454.CMB.2.raw
  modified_base (414)..(414): a, c, t, g, unknown or other
  misc_feature (414)..(414): n is a, c, g, or t
  modified_base (429)..(429): a, c, t, g, unknown or other
  misc_feature (429)..(429): n is a, c, g, or t
  modified_base (462)..(462): a, c, t, g, unknown or other
  misc_feature (462)..(462): n is a, c, g, or t
  modified_base (487)..(487): a, c, t, g, unknown or other
  misc_feature (487)..(487): n is a, c, g, or t
  modified_base (493)..(493): a, c, t, g, unknown or other
  misc_feature (493)..(493): n is a, c, g, or t
tcagacatacgcgtcacgaccggtgctcgatttagctgcgtcacgatctctcttggggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgacggccgggggggtccctgacactctcctgtgcagcctctgattcacagtcagcagcaatcgaccatgagttggcccgcgaggcctaccggagggggtaaggggttgcgtagggtgggtcggtcgggggtattgggaagtgagtggtcgccacacaactacgcagcccgtccggcggacggggccncgttcactcactccncgaagacgaacgtacttaaccgaaacacagtanaactctaggaactaaagtcgtacgngtcccncgacgcccggaccgacggacccgaccgtcccgtcctaacgttccgtggttacgacgtaaccggttaccttcgttacggtttcccgggccgtccggccgtacgttaccgtcggggaaccgtaacccgggg

SEQ ID NO: 356634 - DNA, 803 bp, Homo sapiens
  misc_feature: GZ8MTXP01AFFLZ.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggagtcgttggacgaggccggggggtcctgacactctcctgtgcagcctgtggattcacagtcagcagcaatcgcctaagtggtacggttcggggtaccccgcgaacgggtccgtaccgggaagggggttaaacgggggtttcgaccggtaagggggttcgggggttcccggttacggggggtaacgttttacgggggaaaggttcgggtaaggttcgggggtaaccggaccccctaacgaaacccgtaacccgttaacggaccgtaacggtaaccgttcccgggttaggggaaccgggggtccctacggtttacgaaacgttccgtaaacttcccgtaccgaacggtaacggtaaaccgttaaccgttaaacccgaaaacgtaccgtaagggggttaacgtaaactccgtaggaaacctaaagtcgttaaaccgcgtacccctcgacggcccgaaccgggttaacggaaccgaccggggtcccgttaccttaccgtttcggacgttcggaacccgtaaaaccgtcccgtttaacgtttaaccggtttcccggggaccgtccgggttaaccccgtaaccgggg

SEQ ID NO: 356635 - DNA, 648 bp, Homo sapiens
  misc_feature: GZ8MTXP01BKNRM.22.36.D03.1.454.CMB.2.raw
  modified_base (318)..(318): a, c, t, g, unknown or other
  misc_feature (318)..(318): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagtctatttcctgcacgtgggaaccaacgtgtgactagttgggttctttgactctgtctcgtacgtacaaacaaccaccacgacccaaacccccactcactctatttacnggtctctacctcggtccgccctgacggtagtcctcctctactcgtcttccgaacgtacggtcctaccgtaagttccgtacgaacccgaaaccgtacccggtaccccttacccctaaactacttccgtcggttacgggtccttaccgtaggtttacggaacggtacgtacgttcttaactttacgttacgtcgttacttaacgtttacttaaagtcgtccgtacctacgttcgtggttcggttccggacggtaacgcgttacggtacgttccgtaccgtccgttcgcaccggaacacggccttccggcccttacggccttaaccgttcccg

SEQ ID NO: 356636 - DNA, 611 bp, Homo sapiens
  misc_feature: GZ8MTXP01EAXAT.22.36.D03.1.454.CMB.2.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (315)..(315): a, c, t, g, unknown or other
  misc_feature (315)..(315): n is a, c, g, or t
  modified_base (338)..(338): a, c, t, g, unknown or other
  misc_feature (338)..(338): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagtctattccngcacgtgggaaccaangtgactagttggttctttgactctgtcctctacgtaaccaacaaccacccacgaccccaaacccccatcatctatttagngtctcacgttcgccgcctgaggntctcctcagtcgtcttcacgacgtctacgtaacgttccgaggacccaacggccgtacccctaaccctaaactccttccgtacggttcgggtaccttaccgttagtttacggacgggtactacgttacttactttacttacgtcgtacttacgtttacttaaagtccgctacctcgtcgttggttcggttcggcggtaacgtaccacggtcgttcgtacccgtccgcggttcaccgcgtacgtccgtcccgcccgttcgtccttccgtttcccg

SEQ ID NO: 356637 - DNA, 710 bp, Homo sapiens
  misc_feature: GZ8MTXP01CCOG3.22.36.D03.1.454.CMB.2.raw
  modified_base (284)..(284): a, c, t, g, unknown or other
  misc_feature (284)..(284): n is a, c, g, or t
  modified_base (415)..(415): a, c, t, g, unknown or other
  misc_feature (415)..(415): n is a, c, g, or t
tcagacatacgcgtcacgaccggtgctcgatttagctgcgtcacgatctctcttggggagctctgagagaggagcccagccctgggattttcaggttgttttcatttggtgatcaggactgaacagagagaactcaccatggagtttgggctgaagtggcttttgcttgtggcttattttaaaaggtgtcaagtgtgcggtgaaggtattggagtcgtgggggaggcgttggtacgaggccggggggtccctgacactcgtcctgtgcagcctctggattcacngtcagcagcaatgccagtgtagttggtccgcgaggctcggaaggggtagggttgcgtaggtggtcgtcggggtattagggaagtgagtggtacgacccaacgacgaacgtacggacaaggaccgttccggngggaccggggtccgtcgttcatccgtactccgtaccgaaggaacgaccgtaacgttaaaccccggaaaaaacgaccgtaaggggttaacgtaaacttcccgtaaggtaacctaaaagttacgttaaccgaaaccggtccttaaccgaacggtcccggaacccggtaaccgggaaccgttacccgggtacccgttacttaacccgtttcgttacggttaccgttaccggtaaaaccgttccgtttaacggttttaacggttttccggggaccccggtccggttcccggttaaccgg

SEQ ID NO: 356638 - DNA, 593 bp, Homo sapiens
  misc_feature: GZ8MTXP01A90P6.22.36.D03.1.454.CMB.2.raw
  modified_base (316)..(316): a, c, t, g, unknown or other
  misc_feature (316)..(316): n is a, c, g, or t
  modified_base (475)..(475): a, c, t, g, unknown or other
  misc_feature (475)..(475): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggagtcgttggtacgaggcccggggggtccctgacactctcctgtcgcagcctctggattcacagtcagcagcaatgaccagtgaggttcggccncgaggctaccggagggggtaagggttgcgtaggtgggtcgtcgggggtattggggaaagtgagtgggtacacccaacgacactacgcagaccgtccggaggacgggcgctcatcatctaccagtacgaacgtaactaaccgaaaacacgtaaggggtanaactcctagaactaaagtgacaacgcctacgacgcgccgaacgacgttcggcccttgtaccttcttcgttgacgaacgtccttaacttacggtttcgggaccgtcggcccgtaaccgg

SEQ ID NO: 356639 - DNA, 631 bp, Homo sapiens
  misc_feature: GZ8MTXP01DCPA2.22.36.D03.1.454.CMB.2.raw
  modified_base (218)..(218): a, c, t, g, unknown or other
  misc_feature (218)..(218): n is a, c, g, or t
  modified_base (328)..(328): a, c, t, g, unknown or other
  misc_feature (328)..(328): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaaccaacagtgactattgggtctttgactctgtctctgtaccaacaacacccacgaccaaaccccccactcactctatttatggtgtaactccgtcgccctnaggtactctactccatcgcttctcaacgctcgaagtcgtacgacaacgacggtccctaccctaacctactcctcgtcgggccttccgtaggtttcgacggtacgacggttactaactttaataccgtggtaccttacggtttaaccctttaaagttacggtcccgtacctacgttccgttcggttcgggttttccgggcgggtaacggaaccgtaccggttaaagtccggacccgttccgtcggttaccgcggacccgaacggcctcccgtccccgtcggttcctaaccgttccgtttccccg

SEQ ID NO: 356640 - DNA, 698 bp, Homo sapiens
  misc_feature: GZ8MTXP01AJWAS.22.36.D03.1.454.CMB.2.raw
  modified_base (314)..(314): a, c, t, g, unknown or other
  misc_feature (314)..(314): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgactagttgggttctttgactctgtctctagtaccaacaccacccagaccaaaccctcccaactcatctattatggtntcacgtcgtcgcctgaggtctcctctcatcgtcttctcgaacggtcctaccgaagttccgtcgggacccaaaccgtacccggtaccccttacccctaaacctacttccgtccgttcgggtcccttaccggtaggtttacggaacgggttaccgtaacggttaccttaactttaacgtttacgtacggtacttaacgttttaaccctttaaaagttccggacctaccctacgttccgtttcgggttccgggttttcgggaaccgggtacggacccgtaaccggttaagttcccggtaacccgttcccggttccggttacccgaacccggtccccggtaacgggtcccctacccgggttccccccttcgggttccccttaaccccg

SEQ ID NO: 356641 - DNA, 661 bp, Homo sapiens
  misc_feature: GZ8MTXP01AI3UO.22.36.D03.1.454.CMB.2.raw
  modified_base (307)..(307): a, c, t, g, unknown or other
  misc_feature (307)..(307): n is a, c, g, or t
  modified_base (366)..(366): a, c, t, g, unknown or other
  misc_feature (366)..(366): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggtctaattttaaaaggtgtacaagtgtgcggtgaaggtattggagtcgtgggggagcgttggtacgaggcccggggggtcctgacactctcctgtgcagcctctggattcacagtcagcagtcaatgccatgagttcggcccncaggctacgagggggaagggttcgcgtaggtgggtcgtggggattggaagtcgagtggngccaacacgaactacgcaggacctcggtgggacggggcctcttacactcacttcaccgagacgacgtacgttaaccgaaaacacgagtacgtaactactacgggaactaaagtacgtaccgaacgcccacgacggaccggaccgaacgggaacccgaaccggtcccggttaaccttcgttcgttacggacggaaaccgtaaacggttacccgttcgtttaacggtttttccggggacccggtaacccgggtcccggtaccgttaacccgggttccggggaacccgtaacccgggg

SEQ ID NO: 356642 - DNA, 658 bp, Homo sapiens
  misc_feature: GZ8MTXP01ED2DX.22.36.D03.1.454.CMB.2.raw
  modified_base (222)..(222): a, c, t, g, unknown or other
  misc_feature (222)..(222): n is a, c, g, or t
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctcgccctgacccagcctgcctccgtgtctggatcatctggacagtcgatcagtctactttccngcactcgggaaccaagagtgactagttggttctttgactctgtcctcgtacgtaccaaacaaccacccacgaccccaaaccccccatcatactattagtgtctctctcgtccgcctgagctctccnctatcgtcttcncgacgcctacgaagtctacggaccaaccgccgtacccctaccctaactcttccgtacgttcgggtccttaccgtaggtttaccggacggaacgttacgttacttaaactttacgttacgtacggttacttaacgttttaaccgtttaaagtccggtccttaccgttacgtttccgttcgggtttcggtttccggggacggtaacgtccgaaccggttacgttcggtaccccgttccgttacggttccgaccggtccgaacgtcccttacccgcccccgttgtcccgttcctttccccg

SEQ ID NO: 356643 - DNA, 621 bp, Homo sapiens
  misc_feature: GZ8MTXP01EUURL.22.36.D03.1.454.CMB.2.raw
  modified_base (300)..(300): a, c, t, g, unknown or other
  misc_feature (300)..(300): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtctttgactctgctctgtaccaacaacaccagccaaaccccccatcatctattangtgtcactcgtcgcctcagagtctctcatcgtctctcaggcctccaagtctcggaccaacgaccggtccctaccctaaaccactcctcgtcgggtccttacccgtaggttttggaacggtacgtacgttcttaactttattacgtcgtacgttaacgtttaccctttaaaagttacggccgtacctaccgtttccgttcgggtttcgggttttccgggccgggtaaggtcccgttaaccgggaagttccggtaacccgttccgttaccggttcaccggtccgacggtccgtccgtccccttcgggtccttaaccgttcccg

SEQ ID NO: 356644 - DNA, 688 bp, Homo sapiens
  misc_feature: GZ8MTXP01DDNKP.22.36.D03.1.454.CMB.2.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (310)..(310): a, c, t, g, unknown or other
  misc_feature (310)..(310): n is a, c, g, or t
  modified_base (323)..(323): a, c, t, g, unknown or other
  misc_feature (323)..(323): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcactgggaccaacngtgactagttgggtctttgactctgtctctgtaccaacaacacccacgaccaaaccccccaatcatcatttatgtntcactcgcgcctnagagtctcctcactcgtcttctcgacgctactaaagtcgtacggaccaacgaccggacccctacccctaactactcctcgtcgggtaccctaccgtagtttacgacgggtacgtacgttacttaactttaacttacgttacggtacttaacgttttacccgtttaaaagttaccggccgtaccttaaccgtttccgttcgggtttcgggttttccggggccgggtaacgggtacccgaaacccgggttaaacggttccggttaaaccccggttcccggttacccgggttcccgaaaccggtaacccccgtaaacggtcccgtacccggtccccccgttaccgggttcccttaacccgtttccccg

SEQ ID NO: 356645 - DNA, 696 bp, Homo sapiens
  misc_feature: GZ8MTXP01CP6HC.22.36.D03.1.454.CMB.2.raw
  modified_base (220)..(220): a, c, t, g, unknown or other
  misc_feature (220)..(220): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttccgngcacgacggaaccagagtagacttagttggttctttcgacttctcgtcctaccgtacgtaaccaaaccaacccaaccccgaaccgaacccccaaacccccctaactacctaactactatttacgtaggtactacctaccgttccggtccgtacccgtacgacgtactctcctactatccgtcttacacgacgtctaccgtaacgtcgtacgaccaaccgtacccgtaccctaccctaactactcgtcgtcgtacctacgtagttacgacgtacgtacttacttaacttacttacgtacgttacgtttacgtttaacgttaacgtacgtccgttacctacgttcgttcgggtttacgggttccggcgggtaaccggtacgttacggtaacggttccggtacccgttccgttacggttccgaaccggtcccgtacggtccccgtcccgtccccggttaccgtcccgttcccgttcccg

SEQ ID NO: 356646 - DNA, 633 bp, Homo sapiens
  misc_feature: GZ8MTXP01D6UPI.22.36.D03.1.454.CMB.2.raw
  modified_base (222)..(222): a, c, t, g, unknown or other
  misc_feature (222)..(222): n is a, c, g, or t
  modified_base (333)..(333): a, c, t, g, unknown or other
  misc_feature (333)..(333): n is a, c, g, or t
  modified_base (360)..(360): a, c, t, g, unknown or other
  misc_feature (360)..(360): n is a, c, g, or t
  modified_base (421)..(421): a, c, t, g, unknown or other
  misc_feature (421)..(421): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctcgccctgacccagcctgcctccgtgtctggatcatctggacagtcgatcagtctattttccngactacgtagggaacccaagtgtcgacttagttggttctttgacttctgtcctacgtacgtaacccaaacaaccacccgaacgaccccaaaccccccatcatctatttagngtctcacgtcgccggcctagagtctcnctcatcgtcttcgacgagcctacgatcgtacggacctacgccgtaccctacctactactcncgtcgtctacgtacgttagacgtacgacgttacttaacttacgtttacgtacgtacgtttaacgtttaacgtttaaagtaccgaccgtcccttacttcgttccggtttacggttccgggacggtaaccggacttacggtacgttccgtacgttcgttaccggttcacccgaaccgtacgccgttcccgacccgttcgtccttccgttccccg

SEQ ID NO: 356647 - DNA, 724 bp, Homo sapiens
  misc_feature: GZ8MTXP01CX3H6.22.36.D03.1.454.CMB.2.raw
  modified_base (253)..(253): a, c, t, g, unknown or other
  misc_feature (253)..(253): n is a, c, g, or t
  modified_base (316)..(316): a, c, t, g, unknown or other
  misc_feature (316)..(316): n is a, c, g, or t
tcagacatacgcgtcacgaccggtgctcgatttagctgcgtcacgatctctcttggggggagagaggagcccagccctgggatttttcaggttgttttcatttggtgatcaggactgaacagagagaactcaccatggagtttgggctgaagtggtcttttgcttgtggtcttaattttaaaaggtgtcaagtgtgcggtgaaggtattggagtcgtggggaggtcttggtacagggccggggggtcctgacnctctcctgtgcagcctctggattcacagtcagcagacaatcgaccatggtagttcgggtcccncgacggccgacgggagggggtacgggtgacgtcgggttcggtcgggtagggtagtaggtaggtgtacgttcggacgaccgaaccacaaacgttaccgcgacgtaccggtcgggtacggggaccgggtccgtacgtacgtacttaccacgttcccgtaaccgaaggtaaacggaaacgttaaccgttaaaacccgaaaacacgtaagtaactaacttaccggaagtaaactaaacgttacgaaccgacgtacccgacgaccgacccgggacggtaccgggacccgaccggttccgtaaccgtttccgttgttaccggacgtaaaaccgtaaccgttaaccgtttcgttaacggtttccgggacccgtaaccggtaccgtacggttaccggtcggggaacccgtaacggg

SEQ ID NO: 356648 - DNA, 642 bp, Homo sapiens
  misc_feature: GZ8MTXP01B8R33.22.36.D03.1.454.CMB.2.raw
  modified_base (318)..(318): a, c, t, g, unknown or other
  misc_feature (318)..(318): n is a, c, g, or t
  modified_base (333)..(333): a, c, t, g, unknown or other
  misc_feature (333)..(333): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacgagtgactagttgggtcttttgactctgtctcctggtaccaacaaccacccacggaccaaaccccccaactcatctatttatgtntcactcgtcgccctnagagtctcctcatcgcttctcacggctccaaagtctcgggacctaacgacggtccctacccctaaacctactctcgtcgggtccttcccgtaggttttcgacgggtacgtacgttacttactttactttacgtcgtacgtacgttttaacctttaaagttacggccgtacctaccgttccgttccggtttcgggttttccgggcgggtaacggtaccgttaaccggtaacggttcgaaccccggtccgttccggttcttaccggcccgaacgtccgtaccgcccccgttcggtcccttaacgtttcccg

SEQ ID NO: 356649 - DNA, 772 bp, Homo sapiens
  misc_feature: GZ8MTXP01A1Q76.22.36.D03.1.454.CMB.2.raw
  modified_base (275)..(275): a, c, t, g, unknown or other
  misc_feature (275)..(275): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggcttaattttaaaaggtgtcaagtgtgcggtgaaggtattggagtcgtgggggagcttggtacgaggccggggggttcctgacactctcctgtgcagcctctggattcanagtcagcagcaaatcgacctagtggtaggttcggggtacccgccgtacggtccttacccgggaaggggggtaaacgggggtttcggaccgtaagggtttcgggggttaccgttcgggggggtaatttgggggaaagttggtaagtttcggggtcgacccaaccgaaccgaaacccgttaccggcaacgggtaacccgttcccgggtgggaaccggggggtccctctttacgaacgttcaaacttcctacccgaaggaacggaaccgtaacgtttaaacccggaaaaactaccgtaaggtacgtaaattacccgtagggtaaactaaagtacgtaaccaacggtccctaccgacgacccggacccggtaacggaacccgtaccgggtcccgttaacttaacgtttccgtaggttacggaaaccgtaaacgttaccgttcgtttacggtttccgggccgtccggtaccgtacgttacgggtccggggaacgtcccgggg

SEQ ID NO: 356650 - DNA, 673 bp, Homo sapiens
  misc_feature: GZ8MTXP01EWGL2.22.36.D03.1.454.CMB.2.raw
  modified_base (218)..(218): a, c, t, g, unknown or other
  misc_feature (218)..(218): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
  modified_base (327)..(327): a, c, t, g, unknown or other
  misc_feature (327)..(327): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgactagttgggtcttttgactctgtctctgtaccaacaacacccaggaccaaaccccccatcatcatttanggtntcactcgtcgcctnagntctctcatcgcttctcagctcaagtcctaggacaacgacgtccctaccctaacgactctacgtcgggcttacccgtaggttttacgaacgggtaaccgtacgttaccttaacgtttaactttaccggtacggtaaccttaaccggttttaacccttttaaaacgttaccgggtacccggtacccctaaccgtttccgtttcccggggtttacggtttttccggggacgggtaacggtaccgttaccggtaaacggttcgtaacccggttccgttcgggttccaccggtaaccccgaacggtcccgttcccgtcccccggttacgtaaccgttaacccgtttccccg

SEQ ID NO: 356651 - DNA, 581 bp, Homo sapiens
  misc_feature: GZ8MTXP01ANPD5.22.36.D03.1.454.CMB.2.raw
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
  modified_base (408)..(408): a, c, t, g, unknown or other
  misc_feature (408)..(408): n is a, c, g, or t
  modified_base (561)..(561): a, c, t, g, unknown or other
  misc_feature (561)..(561): n is a, c, g, or t
  modified_base (571)..(571): a, c, t, g, unknown or other
  misc_feature (571)..(571): n is a, c, g, or t
  modified_base (575)..(575): a, c, t, g, unknown or other
  misc_feature (575)..(575): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaaccaacgagtgactagttggttcttttgactctcgctccgtagtaccaacaaccacccacggacccaaaccccccactcactctattatggtcgtcactcgtcggcctgagntctcctcngtcgtcttctcacggtcttaccgaagtcgtggaccaacgaccgcccctacccgtaaaccntcctcggtcggtctcccgtaagtttcggaacggtacgtacgtcttaactttattacggtctacgtacgttacctttaaagcgtccgtactactcggttacgtcggtttcggcggtgtcacggtagttcgaccgtccgttcgcacgtccaggcnccgtccccgngtcnctcccg

SEQ ID NO: 356652 - DNA, 757 bp, Homo sapiens
  misc_feature: GZ8MTXP01AIFZL.22.36.D03.1.454.CMB.2.raw
  modified_base (236)..(236): a, c, t, g, unknown or other
  misc_feature (236)..(236): n is a, c, g, or t
  modified_base (392)..(392): a, c, t, g, unknown or other
  misc_feature (392)..(392): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtcgggaccaacgngtgactagttgggttcttttgacttcgtgtcctcctacggtaccaaacaacccgaccccaacggaccccaaacccccccctaataccactcctaatttagtcggttcgtaccacgtccggtcccggtccctgacggtactctctcactcgtcttcncgagcctccgaagtccgtaggccaaaccgcggtccccttaccctaacctcttaccgtcgtcggggtaccttcgtacggtttacgagggtaaccgtacttacttactttaacgttaccgttacggggtctttaaacgttttaccccgttttaaaaaggtttccgggcccgttacccttaaccgtttccgtttaccggggttttccggggtttccgggttaccggggtacgggaacccgtaaacccgggttaacggttccggacccgggttcccgttacggggttacccaccgggttccccgaaacggggtcccttaacccgggtcccccgttcccgggttcctaacccgttcccgtttcccccggg

SEQ ID NO: 356653 - DNA, 741 bp, Homo sapiens
  misc_feature: GZ8MTXP01BDFHR.22.36.D03.1.454.CMB.2.raw
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (278)..(278): a, c, t, g, unknown or other
  misc_feature (278)..(278): n is a, c, g, or t
  modified_base (397)..(397): a, c, t, g, unknown or other
  misc_feature (397)..(397): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttggctgaagtggtcttttgcttgtggcttaattttaaaaggtgtcaagtgtgcggtgaaggtattggagtcgtgggggagtcttggtacgaggccggggggtcctgacactctcctgtgcngcctnggatcanagtcagcagcaatgaccatggacgttcgggtcccgccgacggccgtaccggagggggtaagggtttcgacggtacggttggggtacgtcggggtacgttagggaagtgtagtcggaacncccgaacacaccgtaccgcgaacgaccggttcgggacgggacggggccttaccgttacactccgtaactcccgtaaccgtaacgggaaaccgaacccgtaaacgttaaccccgaaaaaacgtccggtaaagggtacgtaaacgttaccgtaacgaactaaaaacgttcgtaaaccaccggtccctacgaccggtcccggaacccgggaacggtaacccgaccggggttacccgttaccgttaaccttcggttacgttaccggttaaaccgtaaaacccgggtcctttaaccggtttaacgggtttcccggggttaccccggcgggttaaccccgtaacccgggg

SEQ ID NO: 356654 - DNA, 681 bp, Homo sapiens
  misc_feature: GZ8MTXP01BQ4K0.22.36.D03.1.454.CMB.2.raw
  modified_base (256)..(256): a, c, t, g, unknown or other
  misc_feature (256)..(256): n is a, c, g, or t
tcagacatacgcgtcacgaccggtgctcgatttagctgcgtcacgatctctcttggggttttggggggggtccctgacactctcctgtgcagcctctggattcacagtcagcagcaatgccatgagttgggtccgccagtctccgagggaaggggttgcaggtgggtctcggggattggaagtgagtggtgccacacactacgcagactccgtggaggggccgcttcatcatctccagagacgattaccgaaaacncagtgaatctgacaaatgtacagcctcagcgccgaggacaccggcctctacttctgtgacgaaacgacctcttagtttttcgggcccgcgggtcccgacgtaccgtcgggggcccgacggggcccaacccgttcgggtcctacccggtcctccgttcctaccgccctacccgaacccgaaaccgggggtcccctaacgttcccggttccccgttcccccgtcgggcccgtcccccgtcggtcccttcccgacgggtaccgacccgtaaccccgttcccggggaacggacgacccgaacccggacggccccggccccgttcggggccgttccggcccgtacggtcgaaacgggtaacctacccgttacccgacgttccgtacgtgttacgttggacggtcgggcgtggcgaggcccggcttaagcg

SEQ ID NO: 356655 - DNA, 535 bp, Homo sapiens
  misc_feature: GZ8MTXP01DZOTD.22.36.D03.1.454.CMB.2.raw
  modified_base (304)..(304): a, c, t, g, unknown or other
  misc_feature (304)..(304): n is a, c, g, or t
  modified_base (324)..(324): a, c, t, g, unknown or other
  misc_feature (324)..(324): n is a, c, g, or t
  modified_base (503)..(503): a, c, t, g, unknown or other
  misc_feature (503)..(503): n is a, c, g, or t
tcagacatacgcgtcacgaccggtgctcgatttagctgcgtcacgatctctcttggggagctctgagagaggagcccagccctgggattttcaggtgtttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctcctgtgcagcctctggattcacagtcagcagcaatgccatgagttgggccncaggctccgaggggagggtncgagtggtctcggggattgggaagtgatggtcgcccaacgacacgtacgcaaggacctccggtggacggggcctctcatcatctccagacgacgacttaccgaaaacacaggtagaatctagaccaaatcgtacacgctcgagcgcgaagacgcggccttcgtactcttgttgcgtaanacctcttacgtttgggccgtcggccgtaaccg

SEQ ID NO: 356656 - DNA, 703 bp, Homo sapiens
  misc_feature: GZ8MTXP01CAA8A.22.36.D03.1.454.CMB.2.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttccngcactgggaaccaacngtgactagttgggttctttgactctgtctccgtagtaaccaacaaccaccccacgaccccaaaccccccatcactctatttagtggtctcaccttcgtccggccctgaaggtctcctcctcatcgtccttctacgacggtcctacccgtaaagttcctagggacccaaaccgcccgtccccttaccctaactactcgtccgtcgggtccttaccgtaggtttacggacggtaaccgtacgttaaccttacgtttactttaccgtaggttaaccttaacgttttaaccgtttaaaagttccgggacccttaccgttaacccgtttccgtttacgggtttcgggttttccgggaacgggtaacggttccgaacgggttaacgttccggtaacccgttccgttccgggttaccgaccgtccccggtaagtcccgtacccgggtccccttcgggtcccttaaccgttccccg

SEQ ID NO: 356657 - DNA, 649 bp, Homo sapiens
  misc_feature: GZ8MTXP01CBK6B.22.36.D03.1.454.CMB.2.raw
  modified_base (299)..(299): a, c, t, g, unknown or other
  misc_feature (299)..(299): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttggctgaagtggcttttgcttgtggctattttaaaaggtgtcaagtgtgcggtgaaggtattggagtcgtgggggagcgttggtacgaggccgggggtcctgacactctcctgtgcagcctctggattcacagtcagcagcaatgccatgacgttggccncgaggctaccgagggggaagggttcgcgtagggttgggtcgtacgggggtattagggaagtgacgtcgggtacgccctacgacgaactacgcgagtaccgtcgtggacggggtcctcttcgactcaactcttacagacgaacgtacttaaccgaaacactagtagaatcgtaggactaaagtcgtaacgacgcctacgacggacccgaccggtaacggacccgaccgggtacccgtccgttaccgttcgtacggttacggtaaccgtaacggttcccgttcgtttacggttttcccggggacccgtccgggtaccggtacgttaccgggtcgggaacccgtaacccgggg

SEQ ID NO: 356658 - DNA, 657 bp, Homo sapiens
  misc_feature: GZ8MTXP01BZ2OW.22.36.D03.1.454.CMB.2.raw
  modified_base (312)..(312): a, c, t, g, unknown or other
  misc_feature (312)..(312): n is a, c, g, or t
  modified_base (326)..(326): a, c, t, g, unknown or other
  misc_feature (326)..(326): n is a, c, g, or t
  modified_base (330)..(330): a, c, t, g, unknown or other
  misc_feature (330)..(330): n is a, c, g, or t
  modified_base (335)..(335): a, c, t, g, unknown or other
  misc_feature (335)..(335): n is a, c, g, or t
  modified_base (389)..(389): a, c, t, g, unknown or other
  misc_feature (389)..(389): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaaccaacgtagtgactagttgggtctttgactctgtctctgtaccaacaaccaccacgaccaaacccccatcatctattatgtntcactcgtcgcctnaggntctcnctatcgcttactcgagtcctacagtctacggacaacgaccgccctaccctaacncttctcgtcgggtccttaccgtggtttacgaggtacgtacgttaccttaatttaacttacgttaggtaccttaacgttttaacccgttttaaaacgtcgggtccctaaccttacgtttccgtttccgggtttcgggttttccgggacgggtaacggtaccgaacccggttaaacggttcgtaaccccggttccgttaacgggttccaaccggttccccgaacgggtcccttcccggccccctttcgggtaacccttccgtttccccgg

SEQ ID NO: 356659 - DNA, 616 bp, Homo sapiens
  misc_feature: GZ8MTXP01BOHIO.22.36.D03.1.454.CMB.2.raw
  modified_base (319)..(319): a, c, t, g, unknown or other
  misc_feature (319)..(319): n is a, c, g, or t
  modified_base (383)..(383): a, c, t, g, unknown or other
  misc_feature (383)..(383): n is a, c, g, or t
  modified_base (410)..(410): a, c, t, g, unknown or other
  misc_feature (410)..(410): n is a, c, g, or t
  modified_base (467)..(467): a, c, t, g, unknown or other
  misc_feature (467)..(467): n is a, c, g, or t
tcagacatacgcgtcacgaccggtgctcgatttagctgcgtcacgatctctcttggggagctctgagagaggagcccagccctgggatttttcaggtgttttcatttggtgatcaggactgaacagagagaactcaccatggagtttgggctgaagtggtcttttgcttgtggtcttaatttttaaaaggtgtcaagtgtgcggtgaaggtattggagtcgtgggggagtcgttggtacgaggcccggggggtcctgacactctcctgtgcagcctctggattcacagtcagcagcaatgccagtggagttcgggtccncgaggcctcggaggggtagggttgagtaggtgggtcgtcggggattgggaagtgagtcggtacncccaacacactacgcgagaccgtcggnggacgggtccgacttcgattcgacttcgtaccaagacgacgtaacttaaccgaaaanacgaggtataactctagaactaaagtcgtaacgacgtcctcgaacggccgaccgaacggaccgaccgtcccgttctaccgttcgttcgttcgaaccgaacgttacccttcggtttacggtttccgggcccgtcggttcccgtaaccggg

SEQ ID NO: 356660 - DNA, 605 bp, Homo sapiens
  misc_feature: GZ8MTXP01EPJV3.22.36.D03.1.454.CMB.2.raw
  modified_base (302)..(302): a, c, t, g, unknown or other
  misc_feature (302)..(302): n is a, c, g, or t
  modified_base (510)..(510): a, c, t, g, unknown or other
  misc_feature (510)..(510): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttcctgcacgtgggaaccaagagtgactagttgggtctttgactctgtctctgtaccaacacaccacgaccaacccccatcatctattntagtcgtcaccgtcgtccggcctcaggctctctcatcgcttcacaggtcctacaagtcgtcggacaaccgaccggtccctaccctaaccacttcctcgtcgggtcttaccctaggtttcgacggtactacgttctaactttattacgtgtacgttaacgtttacttaaatcggacctctaaccgttcgttcggttacggttttccggnggtaacggccgttacggtaaacgttcgacccgtcgttccgttacgacggaacccgtacggtcctaccgccccgttacggtccgttaactttcccg

SEQ ID NO: 356661 - DNA, 691 bp, Homo sapiens
  misc_feature: GZ8MTXP01CC7PN.22.36.D03.1.454.CMB.2.raw
  modified_base (346)..(346): a, c, t, g, unknown or other
  misc_feature (346)..(346): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (364)..(364): a, c, t, g, unknown or other
  misc_feature (364)..(364): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaaacgagtgactagtttgggtcttttgactctgtctccgtaggtaaccaaccaaccacccaacggaccccaaaaccccccccatcatctatttagtgtatcactcgtcgcccctnagntctntccatcgctcncgaacggtctccaagtctaggccaacgcccggtccctaccctaacacttccgtcgtacgggccttccgtaggtttacggacgggtaacctaggttaccttactttacttaaccgttggtacgttacgtttacctttaaacgttacgggccctaccgtaccgttccgttcgggttacgggttttccggggcggtaacggtaaccgtaaccggaaaggttccgttacccggttccgtccggttaccgccggttaacccccgtaacgggtccccgtcccgtccccccggttaccggttaccgttaaccccgtttcccgtttaacccccgg

SEQ ID NO: 356662 - DNA, 587 bp, Homo sapiens
  misc_feature: GZ8MTXP01EI7DQ.22.36.D03.1.454.CMB.2.raw
  modified_base (309)..(309): a, c, t, g, unknown or other
  misc_feature (309)..(309): n is a, c, g, or t
  modified_base (402)..(402): a, c, t, g, unknown or other
  misc_feature (402)..(402): n is a, c, g, or t
  modified_base (446)..(446): a, c, t, g, unknown or other
  misc_feature (446)..(446): n is a, c, g, or t
  modified_base (476)..(476): a, c, t, g, unknown or other
  misc_feature (476)..(476): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcgttggtacgaggccgggggggtccctggacactctcctgtgcagcctctggattcacagtcagcagcaatgccatgagttggccncaggctcgaggggtaaggggttgcgtaggtggtcgtcgggggatttggggaaagtggagtggtacgccaacacaccgtacgcaggactcgggnggtacgggccgtctcgatcatctccagacgacgactaccaaaancaggtagatactagacaaactgtacgaacnccgtacgacgcgccggaacggacgaccggccgttcgtacttcgttacgttcgttaccggtaaagtacccgttgttacggttttccgggaccggtccggaacccgtaaccgg

SEQ ID NO: 356663 - DNA, 699 bp, Homo sapiens
  misc_feature: GZ8MTXP01A48LU.22.36.D03.1.454.CMB.2.raw
  modified_base (220)..(220): a, c, t, g, unknown or other
  misc_feature (220)..(220): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctcgccctgacccagcctgcctccgtgtctggatcatctggacagtcgatcagctatttccngcacgtgggaaccaacgagtgactagttgggttctttgactctgtctcgtacgtaaccaacaaccacccacgaccccaaacccccatcatactatttagtgtacgtaactccgtccgcctacgaggtactctctacctactcgtcttccgaccgtaacgtcctccgaagtccgtacgggtaccaaaccgtaccccggtccctaacccctaaactacgttcccgtacgtcgggtccttacccgttaggtttacgacgggtacgtaacgttccttaactttaacttacgtcggtacgtttaaacgttttaacctttaaacgtccggtcccgtacccttacgttaccggtttccgggtttcgggtttaccgggacggtagggaacctaaacgggttcgtaccggcccgtaccgtcggttcccgacggaccccgaaggtcccgtcccggccccgttacggttcccctcgttccgttaaccccg

SEQ ID NO: 356664 - DNA, 644 bp, Homo sapiens
  misc_feature: GZ8MTXP01BWLD6.22.36.D03.1.454.CMB.2.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (359)..(359): a, c, t, g, unknown or other
  misc_feature (359)..(359): n is a, c, g, or t
  modified_base (412)..(412): a, c, t, g, unknown or other
  misc_feature (412)..(412): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctgcctccgtgtctgatcatcgtgacngtcgatcagctatttccngacacgtcggaaccaagtagtgacttagttgggttctttagctctgtcctcgtacgtaaccaacaaccaccccacgaacccaaaccccccatcactctatttagtggtctctacgtcgtccgcctagaggtactcctacnctatcgtcttcacgacgtcactagcctaggaccacgccgtaccctacctaacnctcgtcgacggtctaccgttaggtttacggacgtacgtacttacttaactttacgttacggtcgttaaaccgtttacgttttaaaccgtttaacgtaccggcctacccgttaacgtttccgttcgggtttacgggtttccgggcgggtaaacgtcccgttaaggtaacgccggtacccgtcggttcgccgcgtaacccggcggtccctccgcccgttgccgttccgttcccg

SEQ ID NO: 356665 - DNA, 619 bp, Homo sapiens
  misc_feature: GZ8MTXP01BZ8AG.22.36.D03.1.454.CMB.2.raw
  modified_base (221)..(221): a, c, t, g, unknown or other
  misc_feature (221)..(221): n is a, c, g, or t
  modified_base (239)..(239): a, c, t, g, unknown or other
  misc_feature (239)..(239): n is a, c, g, or t
  modified_base (325)..(325): a, c, t, g, unknown or other
  misc_feature (325)..(325): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggccccagtctgccctgacccagcctgcctccgtgtctggatcatctggacagtcgatcagtctatttccngcacgtgggaaccaacgngtgactagttgggttctttgactctgtctctacgtaccaacaaccacccaccggaccccaaacccccactacactctatttatgtntcactcgtccgcctcgagacgtctcctcactcgtccttctacgacggtctacctaacgtctcggaccaaccgcccggtccctacccgtaactcttccgtcgtcgggtcttaccgtagttcgacggtacgtagttacctattacgttactcgtacttacgttacttaaacgtcgcctcctactcgtcggtttcggtttcgggcggtaacgtccgacgtacggttcgtaccccggttcgacggttccgaccgtccgaccgggtcctcccggccccttggtaacccttcgtttcccg

SEQ ID NO: 356666 - DNA, 652 bp, Homo sapiens
  misc_feature: GZ8MTXP01AJI4X.22.36.D03.1.454.CMB.2.raw
  modified_base (219)..(219): a, c, t, g, unknown or other
  misc_feature (219)..(219): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtcgggaaccaacgagtgactagttggttctttgactctgtctctagtaccaacacacccacgaccccaaaccccccactcatctatttagtgtctccacgttccgtccggccctcgaggtacgtcctccctctactccgtccttcaccaggtccctaccgtaacgtcgcggtaccaaccgaccgtcccctacccctaaccgtactccgtcgtccgggtcctaccgtaggtttagacggtaccgttcgttaaccttacgtttaacttacgtcgtacgttaacgtttaaccgtttaaagtcgtccgtacctaccgttcgttcgggttcgggtttccgggcgggtcgaccgacggtaacgttccggtaccgttccgttacgttccgacgcccgacgccgtcccgtccccgttacgtccgttaacgttcccg

SEQ ID NO: 356667 - DNA, 702 bp, Homo sapiens
  misc_feature: GZ8MTXP01CQOL3.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggcttaagttttaaaaggtgtcaagtgtgcggtgaaggtattggagtcgtgggggagcgttggtacgaggccggggggtcctgacactctcctgtgcagcctcgtggattcacagtcagcagcaatgccagtggacggtttcgggcccgccgaggccgttaccggaagggggtaacgggggttgacgagggttcggggtcgtacgggggtatttaggggaagtggaagtggtacgacccaacgactaaccgtacgacacgccgtccgggtgggacggggccgtcgtcgactcactctaccgaagacgaacgacgttaaccgaaacgaccgaaggtacgtaaacgttctaacggactaaacgtcgttaacgaaccgtcccgtaccgacggacccggacccgggaaacgggacccgttaccggggtacccgttaccgttaacccgtttcgttacggttacgaccggttaaacgtacccgtttaacgtttacggtttttccggggaccccggtccgggttaacccgtaacccggg

SEQ ID NO: 356668 - DNA, 604 bp, Homo sapiens
  misc_feature: GZ8MTXP01CRZ08.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttgggtacaggccggggggtccctgacactctcctgtgcagtcctctggattcacagtcagcagcaagtgaccatgagttgggtccgccaggctccgagggaagggttgcgaggtcgggtacgtcgggggattggaagtgagtggtgcacacaactacgcagactcgggtgaggggccgtctcgatcatctcagacgacgacttaccgaaacacagtagaatctaggactaaacgtgttaaccgagccctacgacggccggacccgacggaccgaccggccgtaacttacgttcgttcgttcgtaacgtaacgttaccgtttacgttacgtttttaacgggcccggtccggtcccgtaccgttaccggtcgggccgtaacccgggg

SEQ ID NO: 356669 - DNA, 523 bp, Homo sapiens
  misc_feature: GZ8MTXP01AWW7L.22.36.D03.1.454.CMB.2.raw
  modified_base (326)..(326): a, c, t, g, unknown or other
  misc_feature (326)..(326): n is a, c, g, or t
  modified_base (386)..(386): a, c, t, g, unknown or other
  misc_feature (386)..(386): n is a, c, g, or t
  modified_base (391)..(391): a, c, t, g, unknown or other
  misc_feature (391)..(391): n is a, c, g, or t
  modified_base (422)..(422): a, c, t, g, unknown or other
  misc_feature (422)..(422): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgctcctggtaccaacaacacccaggcaaaccccccaactcatcatttatggtgtcactcgtcggcccctnaggagtctcctcatcgcttcacaggctccaaagtctggcaacacggccctccctaaaccntctcnggctcgagttgagacgatctacttatacgtnctagttacttaactagcgacctactctcgtggttcggcggcggcgacgacgcgtaccgtccgttcgttcacgccgacgcgtcgtcccgttccgtcgcgtcg

SEQ ID NO: 356670 - DNA, 616 bp, Homo sapiens
  misc_feature: GZ8MTXP01B641P.22.36.D03.1.454.CMB.2.raw
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (307)..(307): a, c, t, g, unknown or other
  misc_feature (307)..(307): n is a, c, g, or t
  modified_base (561)..(561): a, c, t, g, unknown or other
  misc_feature (561)..(561): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcactgggaccaangtgactagttggtctttgactctgtctctgtaccaacaacacccacgacccaaacccccatcatctattatgtntaactcgtcgcctgagtactctctcactcgcttctcaacgtctcaacgtctcggacaacgaccggtccctaccctaaacctcttccgtacgtcgggtccttaccgtaggtttcgaacgggtacgtacgtcttaacttattactcggtacttaacgtttaccgtttaaagtacggcctaccgtacgttccgttcggttcgggtttcgacgggtacgtccgtaaacgttacggtcgacccgttacgtcggttaccncggaccccgtaaggccctccgtcccccgtcggttacctccgttccgttaaccccg

SEQ ID NO: 356671 - DNA, 612 bp, Homo sapiens
  misc_feature: GZ8MTXP01EWPAX.22.36.D03.1.454.CMB.2.raw
  modified_base (302)..(302): a, c, t, g, unknown or other
  misc_feature (302)..(302): n is a, c, g, or t
  modified_base (323)..(323): a, c, t, g, unknown or other
  misc_feature (323)..(323): n is a, c, g, or t
  modified_base (357)..(357): a, c, t, g, unknown or other
  misc_feature (357)..(357): n is a, c, g, or t
  modified_base (395)..(395): a, c, t, g, unknown or other
  misc_feature (395)..(395): n is a, c, g, or t
  modified_base (406)..(406): a, c, t, g, unknown or other
  misc_feature (406)..(406): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggcccgggggggtccctgacactctcctgtgcagcctctggattcacagtcagcagcaatgccatgagttcggccncgaggctcgaggggtagggtncgtaggtggtcgtgggggattggagtgatgggcnccacacaacgtacgcagaccgtccggtggacggggccncttcatcatcnccgagagaacgtacttaaccgaaacacgagtagaatcgaggacaaagtcgtaaccacgtccctcgacggcccggaccggacggacccgtaccgggtcccgttaacttacgttcgtcggttacgaaccgtaacgttacccgttcgttttacggtttccggggccgtccgggcccgtacgttacgggtcggggaacccgtaaccgggg

SEQ ID NO: 356672 - DNA, 686 bp, Homo sapiens
  misc_feature: GZ8MTXP01AP9XG.22.36.D03.1.454.CMB.2.raw
  modified_base (329)..(329): a, c, t, g, unknown or other
  misc_feature (329)..(329): n is a, c, g, or t
  modified_base (352)..(352): a, c, t, g, unknown or other
  misc_feature (352)..(352): n is a, c, g, or t
  modified_base (388)..(388): a, c, t, g, unknown or other
  misc_feature (388)..(388): n is a, c, g, or t
  modified_base (418)..(418): a, c, t, g, unknown or other
  misc_feature (418)..(418): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctcgccctgacccagcctgcctccgtgtctggatcatctggacagtcgatcagtctatttcctgcacgtgggaaccaacgtagtgactagttgggttcttttagacttctcgtcctccgtacggtaaccaaacaccacccaacgaccccaaaccccccatcatctatttanggtctcacttcgccggcctacgngacgtctcctctactcgtctctcacgtctacagtcncggaccaaccgccgtaccctacctaaaccnctacgtcgtacggtcttacccgtagtttcgaacggtacgtacttacttatttacgttaacgtcgtacgtttacgtttaaccgtttaaagtccggtccctacgtacctttcggttccggtttggtttacccgggcgggttaacggtacccgttaaacgggtacgttcggtaaaccccggtttccgttaccggttccgttaaccccggtcccggtaacggtccttcccccgggtaccccgttacgggttccccgttaaccctttccccgg

SEQ ID NO: 356673 - DNA, 586 bp, Homo sapiens
  misc_feature: GZ8MTXP01AP758.22.36.D03.1.454.CMB.2.raw
  modified_base (401)..(401): a, c, t, g, unknown or other
  misc_feature (401)..(401): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcatcagctatttcctgcactcgggaaccaacagtgactagttgggttcttttgactctgtctctggtaccaacaaccacccagacccaaacccccatcatcatttatgtcgtcactcgtcgcctcgaggactctcctcatcgtcttctacacggcttaccgaaagtcgtaggaccaacgaccgtccctaccctaaacnctctcgtcggctccgagttgaggtactacgtcttaacttatacgtctacgttactttaaccgttaagtacggtcctacctacgttcgttacgggttcggtttcggcgggtaagccgttacggaagttccgaccgtcgttcgttcgaccgtccgacgtccgtccgtacccgttcgtcttccgtccg

SEQ ID NO: 356674 - DNA, 658 bp, Homo sapiens
  misc_feature: GZ8MTXP01A83QN.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggcgttggtacgaggccggggggtccctgacactctcgtgtgcagcctctgattcacagtcagcagcaatgccagtgagttcggtccgccgaggccgtccgtagggggaagggttgacgtagggtcgggtcgtcgggggtattgggaagtgacgtggtcgaccacaccaactacgcacggacctcgggtacggaggggtccccgtcttccgacttcgactcctacccgaagaacgaccgtacgttaacccgaaaacgacgagtacgaacgttcgtacgggtaacaaagttacgtacgaccgtacccgcacggacccgaccggtaacggacccgtaccggcccgtccgttacgttacgtgttacgacgtaaacgttcccgttacgtttacggttttccgggcccgtcgggccgtaccgttcggtccggggccgtaaccggg

SEQ ID NO: 356675 - DNA, 690 bp, Homo sapiens
  misc_feature: GZ8MTXP01AM8VX.22.36.D03.1.454.CMB.2.raw
  modified_base (307)..(307): a, c, t, g, unknown or other
  misc_feature (307)..(307): n is a, c, g, or t
  modified_base (418)..(418): a, c, t, g, unknown or other
  misc_feature (418)..(418): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagcatttcctgcactgggaccaacgagtgactagttgggtcttttgactctgctcctgtaccaacaaccacccacgaccaaaccccccatcatcatttanggtgtcactcgtcgccctgacggactctcctcgtatccgtacttctaccgacggtcctaccgtaaagttccgtacggaccaaccgacccgggtccccttacccctaaaacncttacctccggtcgggtaccttccgtaagggtttacggaacggtaccgtacgttacctactttaacttaaccgttcggtaccttaacggtttaaccctttaaaacgttcgggtacctacccgttaccttcggtttccggttgggggttttccgacggggtaacggtacccgaaccggtaagttccggtaacccgtcccgttcggttccgaaccggtccccgaagggtcccgttacccggcccccgttcgggtaacccttaacgtttccccgg

SEQ ID NO: 356676 - DNA, 663 bp, Homo sapiens
  misc_feature: GZ8MTXP01ALM5E.22.36.D03.1.454.CMB.2.raw
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (237)..(237): a, c, t, g, unknown or other
  misc_feature (237)..(237): n is a, c, g, or t
  modified_base (441)..(441): a, c, t, g, unknown or other
  misc_feature (441)..(441): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctcgccctgacccagcctgcctccgtgtctggatcatctggacagtcatcagctattccngcacgtcggaaccaangtnactagttggtctttgacttctgtcctccgtacgtaaccaacaaccacccacggaccccaaaccccccatcactactagtttacgtcggtcgtctaccgtcggtccgtccgtacgaggtacgttcctcctactactccgtccttcctaacgacggtcctaccgtaacgtcgtacgaaccaaccgaccgtcccctaccctaacctntccgtcgtcggccttaccgtagtttcggacggtacgtacgtacttacgtttactacgtcgttacgttacgtttaaccgttaaagtcggcctaccgtacgtttcgttccggttcgggtttcggcgggtaagtcccgacggtaacggttccgtaacccgtcgttccggttacaccgtaacccggagtcccgtcccgtcccgttcgtaaccgttccgtttccccg

SEQ ID NO: 356677 - DNA, 584 bp, Homo sapiens
  misc_feature: GZ8MTXP01C53DE.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgccacgtgggaacccaacagtgactagttgggtctttgactctgctcctggtaccaacaacacccacggaccaaaccccccaactcatcattatgtgtcactcgtccgccctcaggagtctcctcatcgtcttctcagctccaagtctcggacaacgacggccctaccctaaccactctcgtggctcgtagtttgaggacgagtctaacttacttactcgtactacgtttaccttaaagttacggctccctactcgttcggttcgggtttcgggcgggtcgggcgaccggtaacgcggtacccgtccgttcggttcaccgcccgaacgccgtcccggtcccccttcggtccttaaccgttccccg

SEQ ID NO: 356678 - DNA, 750 bp, Homo sapiens
  misc_feature: GZ8MTXP01BZM9W.22.36.D03.1.454.CMB.2.raw
tcagacatacgcgtcacgaccggtgctcgatttagctgcgtcacgatctctcttgggggagagaggagccccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccgggggtccctgacactctcctgtgcagcctctggattcacagtcagcagcaatcgaccagtggtaggttcggggtccccgccgaacgggtccgtacccgggaaggggggtaaacgggggtttcgacggtaggggtttcgggggtccggtacggggggtaatttaggggaaaggttggtaagttcggggtacgacccgaaccgaaccgtaaacccgttaccgcgaaacgggtaaccccgttcccggggtacgggaccggggggtcccctcgtttacctacttcacttccgtaccgaaggaacgaaccgtacttaaccgaaaacacgagtacgtaatctagggaactaaagttcgtaccgaacgccctacgacggacccggccggaaccggaccgaccgggtcccgttaaccgttaccgttcgtacggttcgaaaccggtaacgttacccgttcgtttacggttttccggggcccggtccggtacccgtaccgttaccgggtcggggcccggtaacccggg

SEQ ID NO: 356679 - DNA, 637 bp, Homo sapiens
  misc_feature: GZ8MTXP01BABD1.22.36.D03.1.454.CMB.2.raw
  modified_base (359)..(359): a, c, t, g, unknown or other
  misc_feature (359)..(359): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacagtgactagttgggttctttgactctcgtctcctcgtaaccaacaaccacccacggacccaaaccccccatcactctatttagtgtctcactcgtcgccctgaggctctcctcatcgtcttcacncggtctccgtaagtctacggacaacgaccgccccttacccaaacgtctccgtcgtcgggccttaccgtagtttacggacggtaacgtacttcttaactttacttacgtcgtacttaacgtttaccttaaagtcggccgtacctacgttcgtacggtttcggtttccgggacggtaacgccgttaacggtaacgttcgtacccgtccgttccggttcacccggtaacccgtaacggtcccgttccccgccccgttacgggtcccttaaccggttccccg

SEQ ID NO: 356680 - DNA, 713 bp, Homo sapiens
  misc_feature: GZ8MTXP01EBTWU.22.36.D03.1.454.CMB.2.raw
  modified_base (227)..(227): a, c, t, g, unknown or other
  misc_feature (227)..(227): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacnggccgggggggtccctgacactctcctgtgcagcctctggattcacagtcagcagacaatcgccaagtcggaggtttcggggtccccgaccgacgggccgtcccggaagggggtaacgggggtttggaccgtagggggtttgggggttccggttacggggggtagtttggggtaaaggtggtaagttaggggtacgcccgaactacccgaaaccttaccggcgtaggacccgttccgggtcgggacgggggcccgtcgtttcactcctaacttccaccgagaacgaaccgtaattaacccggaaaaccacaagtgaaacttctaagggactaaacgttataacgacgtcccgcgacgaccgccggtaggaccgtacccggcccgtaacttccgttcgtcgttacgacgtaaaacggttcccttcgttttacggttttccgggccgcccggtccgtaacgttcgggtaacggggcccgtaaccgggg

SEQ ID NO: 356681 - DNA, 698 bp, Homo sapiens
  misc_feature: GZ8MTXP01B02LY.22.36.D03.1.454.CMB.2.raw
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctgccctgacccagcctgcctccgtgtctggatcatctggacagtcgatcagtctatttccngcacgtggaaccaagngtgactagttgggttactttgactctgtctcgtagtaccaacaaccacccacgaccaaaccccccaatcactctatttatgtgtcctactccgtcggccctagaggactctaccctcgtactcgtccttcgtacaacgggtcctaccgtaaagtccgtacgggaccaaacccgaccggtcccctacccttaaactcttccgtcgtacggtctaccgtagtttacggacggtacgtactcttaattacgttacgtcgtacgttaactttacgtttaaaacgtcggtcctacttaaccgtttcgttccgggtttgggttttccgggacgggtaaccggtcgttaacccgggtaaagttccgggtaaaccccgttccggttaccgggttcccgaaaccgggttaaccccgacggggtccccttccccgggcccccgttacgggtcccttaacccttttccccgg

SEQ ID NO: 356682 - DNA, 722 bp, Homo sapiens
  misc_feature: GZ8MTXP01BQEV4.22.36.D03.1.454.CMB.2.raw
tcagacatacgcgtcacgaccggtgctcgatttagctgcgtcacgatctctcttggggagctctgagagaggagcccagccctgggattttcaggttgttttcatttggtgatcaggactgaacagagagaactcaccatggagtttgggctgaagtggtcttttgcttgtggtacttaattttaaaaggtgtacaagtgtggcggtagtaaggtagttggagttcggtgggggaggtcgttagggtacgacgggtcccggggggtccctgactactctcctgtgcagcctctggtattcacagtcagcagactaatcgacctagtggtacggttcgggtcccgacgaggtcctaccgggaaggggtaaggggttgcgtaggttcgggtcgtgggggtacttaggaagtgagtcggtcaccaacgactacgtacgcacgtacgtcggtagggaccgggtcctacgtcacgtactcgttacccgacgaagacgtaaccgtaaccttaaaccgaaaagtccaaggggttacgaaatttccgaacgtaactaaacgtcggaaacctaccgaccgtcggaaaccgtcccggaccgggaaacgtaaccccggccgggttcccttacgttaccgttacgttaacgggttcgaaacccggggtaaactttaccgttcgggttttaacgggtttcccggggacccgtccgggttaacccgttaacccggg

SEQ ID NO: 356683 - DNA, 611 bp, Homo sapiens
  misc_feature: GZ8MTXP01CFF04.22.36.D03.1.454.CMB.2.raw
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctgccctgacccagcctgcctccgtgtctggatcatctggacagtcgatcagctatttccngcacgtgggaccaacngtgactgttggtctttgctctgtctctgtaccaacaaccacccacgaccccaaacccccactcactctatttagtggtcgtccacgttccgtccggtcccctcgacggtcgtcttccctcactcgtccttctacgacggcctacctaagtcctcggaccaacgaccggtacccctaccctaaccgtactccgtcgtcgggtcctaccgtaggtttcggaacggtacgtacgttacttaactttacgttaccgtgtacttacgtttacctttaaagtcggcctcctacttcgttcgttcgggtttcggcggtaacgcgttacgagttcgtccgtcgttcgttcacgcccagtcctcgtccccgttcgtccgctccg

SEQ ID NO: 356684 - DNA, 605 bp, Homo sapiens
  misc_feature: GZ8MTXP01EAMKZ.22.36.D03.1.454.CMB.2.raw
  modified_base (220)..(220): a, c, t, g, unknown or other
  misc_feature (220)..(220): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctgccctgacccagcctgcctccgtgtctggatcatctggacagtcgatcagctatttccngcacgtgggaaccaagagtgactagttgggttcttttgacttctgtcctcctacggtaccaaacaccacccacgacccaaacccccatcatctattagtgtctcactcgtccgctcagtactctcctctatcgtcttcacacggtctacaagtcgtacgaccaacgaccgtccctaccctaactctcgtcgtcggtccttacgtagtttggacggtacgtacgttacttaacttacttacggtgtacttaacgtttaaccttaaagttcggcctacttaacgtcgttacgggttcggtttccggacggtcgtacgttacggtacgttcgtaccgtccgttcgttcacgcccaggtcctcccgcccgttacgtccgttcgttcccg

SEQ ID NO: 356685 - DNA, 684 bp, Homo sapiens
  misc_feature: GZ8MTXP01BBAZO.22.36.D03.1.454.CMB.2.raw
  modified_base (332)..(332): a, c, t, g, unknown or other
  misc_feature (332)..(332): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttgggtacagggcccggggggtccctgacactctctgtgcagcctctggattcacagtcagcagcaatgccatgaggttgggcccgccgaggctccggagggggtaagggtncgaggtgggtcgtgggggattgggaagtgagtgggtcgccaacacgaactacgcgaggacccgtccgggtgggaaccgggggccctcgtttacacgtcaactctccgaagaggaaccgtaacttaaaccgaaaaccaacgaagtagaaacttacgtacgaacgtaaagtagtaacgacgacctaccgacggaccggaccggaacgggaaccgaccgggtaccggtaaccttaccgttaccgtacggttacgtaaacggtaaacgttacccgtttacgtttacggtttttccggggcccggtccggggtacccgtacggttaccggtccgggggttaacccggtaacccgggg

SEQ ID NO: 356686 - DNA, 642 bp, Homo sapiens
  misc_feature: GZ8MTXP01DZR7E.22.36.D03.1.454.CMB.2.raw
  modified_base (219)..(219): a, c, t, g, unknown or other
  misc_feature (219)..(219): n is a, c, g, or t
  modified_base (328)..(328): a, c, t, g, unknown or other
  misc_feature (328)..(328): n is a, c, g, or t
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtcgggaaccaatagtgactagttgggttcttttgactctgtcctccgtacggtaaccaacaaccaccccacgaccccaaaccccccaactcatctattagtgtntcactcgtccgccnagtgtctcncntctctcncacgtctaccagtctacgaccaccgaccgtaccctaccctaacctacttcgtcgtcggcttaccgtagtttcgacgacggtataccttaacttacgttacgtcgtacttacgtttacctttaaagtcgccgtacctacgttccgttcgggtttacggttccggggcgggtaacgtaccggttaacggtaaacggttccggtaaccccggttcgttccgggttccaccggaacccgtaacgtcccgtacccggtcccccgttcggtcccttaacgtttccccg

SEQ ID NO: 356687 - DNA, 657 bp, Homo sapiens
  misc_feature: GZ8MTXP01E08QC.22.36.D03.1.454.CMB.2.raw
  modified_base (237)..(237): a, c, t, g, unknown or other
  misc_feature (237)..(237): n is a, c, g, or t
  modified_base (570)..(570): a, c, t, g, unknown or other
  misc_feature (570)..(570): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtcgggaaccaanagtgactagttgggtctttgacttctcgtctctacggtaaccaacaaccacccgacgacccaaaccccccatacatactattatgtctcaccgtccggtccggccctcgaggtacgtcctccctctacttccgtccttaccgtaccgacgtcccgtaccgtaacgtcgtacggacccgtaaaccgaccccgggtaccccttacccctaacctacttccgttccgttcgtaccttaccgttaggtttacggacgggtacgtacgttaccttaacttacttacgtgtacttacgttacttaagtcgtccgtcctacttcgtcggttcggttcggnggtaacgacgacggtaagttccgtaccgtccgttcgttcaccgtaaccgacggtccgtccgtcccgttaccggtcttcccgttcccg

SEQ ID NO: 356688 - DNA, 634 bp, Homo sapiens
  misc_feature: GZ8MTXP01EL3I0.22.36.D03.1.454.CMB.2.raw
  modified_base (238)..(238): a, c, t, g, unknown or other
  misc_feature (238)..(238): n is a, c, g, or t
  modified_base (324)..(324): a, c, t, g, unknown or other
  misc_feature (324)..(324): n is a, c, g, or t
  modified_base (612)..(612): a, c, t, g, unknown or other
  misc_feature (612)..(612): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtcgggaaccaacgngtgactagttgggttctttgactctcgtctcctcggtaacaacaaccacccgacgacccaaaccccccactcactctatttatgtntcactcgtacggccttcgaggtcgtctccctctacgtccgtctttccgaccgtacgggtccttaccgtaagttccgtacggaccctaaaccgccgggtacccccttaccctaaacctcttccgttcggtcgggtccttacccgtaggtttcgaacggtacgtacgttacttaacttacgttactcgtacgttactttaccgttaaagtcggacctcgtacgttcgtcggttacggtttcggcggtaacgcgaccgtagttcgaccgtcgttcggcacgtccgagtccncgtccccttcgtccgcttcccg

SEQ ID NO: 356689 - DNA, 720 bp, Homo sapiens
  misc_feature: GZ8MTXP01AWF5R.22.36.D03.1.454.CMB.2.raw
  modified_base (275)..(275): a, c, t, g, unknown or other
  misc_feature (275)..(275): n is a, c, g, or t
  modified_base (290)..(290): a, c, t, g, unknown or other
  misc_feature (290)..(290): n is a, c, g, or t
tcagacatacgcgtcacgaccggtgctcgatttagctgcgtcacgatctctcttggggggagagaggagcccagccctgggatttttcaggttgttttcatttggtgatcaggactgaacagagagaactcaccatggagtttgggctgaagtggtctttttgcttgtggcttaatttttaaaaggtgtcaagtgtgcggtgaaggtattggagtcgtgggggaggtcttgggtacgacgggcccgggggggtccctgacaccttctcctgtgcngcctctggattcacngtcagcagacaatcgaccatggaggttcggcccgcgaggcctaccggagggggtaacggggttgcggtagggtcggggtcggtcgggggtaatttaggggaagttggacgtgggtacgaccaacgactaaaccgtacgcgaacgtacccgtcgggtacgggacgggggtccctcgttaccatcgactcctaccgagaacgaacgtaaccttaaaccgaaaccgtaaccgagtaacgaagtactacgggaactaaagtacgtaacgaccgacctaccgacggccggaccggacggaccggtacccggtccgttaaccgtacgttcgtacgttacggtaaacgtaaacgttacccgttccgtttacggtttttccggggcccgtcccgggtacccggtaccggttaccgggttccgggccggtaacccgggg

SEQ ID NO: 356690 - DNA, 894 bp, Homo sapiens
  misc_feature: GZ8MTXP01A7JV6.22.36.D03.1.454.CMB.2.raw
  modified_base (204)..(204): a, c, t, g, unknown or other
  misc_feature (204)..(204): n is a, c, g, or t
  modified_base (270)..(270): a, c, t, g, unknown or other
  misc_feature (270)..(270): n is a, c, g, or t
  modified_base (449)..(449): a, c, t, g, unknown or other
  misc_feature (449)..(449): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggtcttaattttaaaaggtgtcaagtgtgcggtgaaggtntggagtcgtgggggagcgttggtacgagggtccggggggtcctgaccactcctcctgtgcagcctntgattcacaggtcagcagcaatcgaccctagtggtacggtttcggggccccgaccgaacgggtcccgtacccggtaaaggggggtaaacgggggtttcgaccgtaaggggtttcgggggttccgttaccggggggtaatttgggggaaacgttggtaaggttcgggtcgaccccgtaanaacccgtaacccgtaacggcgtaagggtaccccgttacccggggtggaaaccgggggtcccttacggttactactacctactaccgttaacccgaaggtaacgtaaaccgtaaccgtttaaaacccgtaaaaccgactaaccggttaaggtaaacttccgttaacgggaacggttaaaacttaccgttaaacccgtaacggtaccccgtacgaaccggaccccgggttaacccggtaaccgggaacccggtaacccggttacccggttaacccgttaaccttttccgggttaacggaccgggtaaacccggttaaaaccggttacccccgttttggttttaaacccggggtttttaacccgggggcccccgggttaacccggggtaaccgggtaccccgggtttaacccgggtccgggggttaaccccggtaaacccccgggggg

SEQ ID NO: 356691 - DNA, 724 bp, Homo sapiens
  misc_feature: GZ8MTXP01ATMKN.22.36.D03.1.454.CMB.2.raw
  modified_base (221)..(221): a, c, t, g, unknown or other
  misc_feature (221)..(221): n is a, c, g, or t
  modified_base (240)..(240): a, c, t, g, unknown or other
  misc_feature (240)..(240): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctgccctgacccagcctgcctccgtgtctggatcatctggacagtcgatcagtctatttccngcacgtcgggaaccaacgngtgactagttgggttctttgactctcgtcctaccgtacggtaaccaaaccaaccaaccccgaaccggaacccccaaaacccccccctaactacctaactacttaacgttttacgtacggttcgtacctaccgttcccggtaccggtcccctacgtacgggtacttcctccctactacgttccgtcctttcctacgacggtcctaccgtaacgtccgtacgggaccaaaccgtccgtacccctacccgtaactacttccgtcgtcgggtcttaccgtaggtttacgacggtactacgttacttaagtttactacggtgtaccttacgtttacctttaaagtcggtcctaccgtacgttcgttcgggttacgggtttcgggaccggtaacggtaccgttacgggtaacgttccggtacccgttccgttacggttcgaccggtcccgacggtccctacccgccccgttcgtaaccgttcgtttcccc

SEQ ID NO: 356692 - DNA, 690 bp, Homo sapiens
  misc_feature: GZ8MTXP01A96QE.22.36.D03.1.454.CMB.2.raw
  modified_base (221)..(221): a, c, t, g, unknown or other
  misc_feature (221)..(221): n is a, c, g, or t
  modified_base (237)..(237): a, c, t, g, unknown or other
  misc_feature (237)..(237): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcgagggcacgagggtcctgggcccagtctgccctgacccagcctgcctccgtgtctggatcatctggacagtcgatcagctatttccngcacgtgggaccaacngtgactagttggtctttgactctgtctcctggtaaccaaacgaccacccacggacccaaaccccccagtcactctagtttatggtactcaccgtccggtccggccccttgaacggtcgtcctcccctactacgtccgtccttctacgacgtccttaccgaaacgttccgacggaccaaccgaccggtacccttacccctaaacactacgtccgtacggtcctaccgtagtttacggacggtaccgtacgttacttactttaacttacggtacgtacgttaacgttttaaccgttaaaagttccggcgtaccctaacgttcgttcggggtttacgggtttccgggacgggtaacggccgttaaacgggtaacgttaccggtaaccggttcccgttcgggttaccgacgaaccccgaggtccctccggtccccgttcggtccttaacgtttcccg

SEQ ID NO: 356693 - DNA, 789 bp, Homo sapiens
  misc_feature: GZ8MTXP01BKOM9.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggtcgttgggtacgagggcccgggggggtccctgaccactctcctggtcgcagtcctcgtggattcacagtcagcagcaatgccagtggtaggttcgggtcccgccgaggccgtccggaagggggtaacggggtttgacggtagggttcggggtcggtacgggggtagttggggaaagtggagttgggacgacccaacgacaccgtacgacgacgtaccgtccgggtagggaccgggggtccctcgttacgacttacctaacgttcccgtaacccgaaggtaaccggtaaacccgtaaacgttaaaccccggaaaaaacgtacccgtaaagggggttaacgtaaacttaccgttaacggaaacctaaaacgttccggtaaaccaaacccgggttcccctaacgggaccgggtccccggaacccggggtaaacgggaaccccggttacccggggtaccccttccgttaaacccgttccgttacgggttaccgaaccggttaaaaccgtcccgtttaacgtttaccgggtttccggggccccggtaacgggttccccgttaaccggg

SEQ ID NO: 356694 - DNA, 562 bp, Homo sapiens
  misc_feature: GZ8MTXP01E1S9C.22.36.D03.1.454.CMB.2.raw
  modified_base (371)..(371): a, c, t, g, unknown or other
  misc_feature (371)..(371): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
  modified_base (411)..(411): a, c, t, g, unknown or other
  misc_feature (411)..(411): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactagttgggtcttttgactctgcctctggtaccaaacaacacccaggaccaaacccccccaactcatcattatggtgtcactcgtcggccctcaggatctcctcatcgctctacaggctccaagtctggcaacncgcctcccaaacnctctcngggctccagtttnacggaacngtctacttagttactgctacgtttacctttaaattacggccgacctactcgttcgttggggttttcggcgggaacggcaccggtaagttcggaacctcccgacggttccaacgccccgaaggtcctcgaccccccttcgtccaacttcccg

SEQ ID NO: 356695 - DNA, 716 bp, Homo sapiens
  misc_feature: GZ8MTXP01E0UBK.22.36.D03.1.454.CMB.2.raw
  modified_base (227)..(227): a, c, t, g, unknown or other
  misc_feature (227)..(227): n is a, c, g, or t
  modified_base (238)..(238): a, c, t, g, unknown or other
  misc_feature (238)..(238): n is a, c, g, or t
  modified_base (259)..(259): a, c, t, g, unknown or other
  misc_feature (259)..(259): n is a, c, g, or t
tcagacatacgcgtcacgaccggtgctcgatttagctgcgtcacgatctctcttggggttttgggggggggtccctgacactctcctgtgcagcctctggattcacagtcagcagcaatgccatggagttgggtccgccaggctccgaggggaaggggttgcaggtgggtctcggggattggaagtgatggtgccacacactacgcagactccggtggacggggccncttcatcatcncagagacgattaccgaaaacncgagtgaatctagacaaatacgtacacgcctcgacggccggaccggaacggaccgaccgggtcccgttaccttactttcgtagtcggaacgaaacgtaccctttacgtttacggtttttccgggggcccggcccgggaccggtaacccgtaccgggtcgggggacccgacggggtcccctaacccgttcggtcccgtacccgtcttccttccgaccgtccctcccgaaccggaaccggccctacgtcccggttcccttccccggcggccccgcctcgcctaccgacggccgccgaccgtccggacgacgccgacgccggcccggccgtcggcgtacgtccgtacggtaaccgaacggtccttaacccgttcccgacggtttaccgtacgttacggttccgttcggggaccgggccgggggttccgcgggaccggacgggacccgaacgttaacgtgg

SEQ ID NO: 356696 - DNA, 618 bp, Homo sapiens
  misc_feature: GZ8MTXP01EE76E.22.36.D03.1.454.CMB.2.raw
  modified_base (222)..(222): a, c, t, g, unknown or other
  misc_feature (222)..(222): n is a, c, g, or t
  modified_base (237)..(237): a, c, t, g, unknown or other
  misc_feature (237)..(237): n is a, c, g, or t
  modified_base (261)..(261): a, c, t, g, unknown or other
  misc_feature (261)..(261): n is a, c, g, or t
  modified_base (323)..(323): a, c, t, g, unknown or other
  misc_feature (323)..(323): n is a, c, g, or t
  modified_base (358)..(358): a, c, t, g, unknown or other
  misc_feature (358)..(358): n is a, c, g, or t
  modified_base (540)..(540): a, c, t, g, unknown or other
  misc_feature (540)..(540): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctcgccctgacccagcctgcctccgtgtctggatcatcgtgacagtcgatcagtctatttccngcacgtggaaccaangtgacttagttggttctttagctntcgtctcgtacgtaaccaacaaccacccgacgaccccaaaccccccatcagtctatttacgngtctcctaccgtcgccgtcctagaggtactctccnctacgtcgtaccttcgaacacggtctactagtccgacggacctaacgccgtaccctacctacgtactcgtcgtacggtcttacgtagttacgacgtacgtactattaacttattcgtagtacgttaacgtttaaccgttaaagtcggccctcgttacgttcgttcggtttcgggttcccggnggttaacgcgttacgtagttccgtaccgtcgttcggttcacgccgacgtcctcccgtccgttacgtccttcgttcccg

SEQ ID NO: 356697 - DNA, 633 bp, Homo sapiens
  misc_feature: GZ8MTXP01B58A0.22.36.D03.1.454.CMB.2.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (624)..(624): a, c, t, g, unknown or other
  misc_feature (624)..(624): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacngtgactagttggtctttgactctgtctctggtaaccaacaacacccacgaccaaaccccccatcatctattatggtctccacgtcgtacggccccttagacggacgtctaccctcacgtccgtcttacctccgacgggtccttaccgtaaacgtcgtacggaccgtaaacccgccggtacccctaccccgtaaccacgtcctccgtcgggtctacccggtagtttcggacgggacgtacgtacttaacgttacttacggtgtaccttacggtttaacctttaagtcgacgtccgactttcgtcggttggtttcgggcggtaacggccgacgtacgttcgtaccggttccttcggttcacgtcccgacggcctccgtccccgttcgtaaccncctttcccg

SEQ ID NO: 356698 - DNA, 653 bp, Homo sapiens
  misc_feature: GZ8MTXP01A50DG.22.36.D03.1.454.CMB.2.raw
  modified_base (222)..(222): a, c, t, g, unknown or other
  misc_feature (222)..(222): n is a, c, g, or t
  modified_base (318)..(318): a, c, t, g, unknown or other
  misc_feature (318)..(318): n is a, c, g, or t
  modified_base (565)..(565): a, c, t, g, unknown or other
  misc_feature (565)..(565): n is a, c, g, or t
tcagacatacgcgtcacgaccggtgctcgatttagctgcgtcacgatctctcttggggtggggtctcaggaggcagcgctctcgggacgtctccaccatggcctgggctctgctattccctcaccttcctcactcagggcacgagggtcctgggcccagtctgccctgacccagcctgcctccgtgtctggatcatctggacagtcgatcagtctatttccngcacgtgggaccaagagtgactagttggttactttgacttctgtctccgtacgtaaccaacaacacccacgacccaaacccccatcatctatttangtctcacgtcgtccggcctgaggtctctcctcatcgtcttcgacgacgtctaccgtaaagttccgtaggaccctaacccgacccgggtccccttaccccaaactccttccgtcgtcgggtccttaccggtacggtttaggacgggtacgtacgttaccttaactttacgtacggttcggtactttaaccgttacctttaaaagtcggtaacccgtctaccgttcgttaccgggttggttttaccggngggtaacgcgaccgggtagccggtcccgtcgttccgggcttaccggcccgaggtcctcccgggtccccttacggtccttccgtttccc

SEQ ID NO: 356699 - DNA, 617 bp, Homo sapiens
  misc_feature: GZ8MTXP01BS8PZ.22.36.D03.1.454.CMB.2.raw
  modified_base (221)..(221): a, c, t, g, unknown or other
  misc_feature (221)..(221): n is a, c, g, or t
  modified_base (275)..(275): a, c, t, g, unknown or other
  misc_feature (275)..(275): n is a, c, g, or t
  modified_base (324)..(324): a, c, t, g, unknown or other
  misc_feature (324)..(324): n is a, c, g, or t
  modified_base (357)..(357): a, c, t, g, unknown or other
  misc_feature (357)..(357): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctcgccctgacccagcctgcctccgtgtctgatcatctggacagtcgatcagctattttccgngctacgtcgggaaccaaacgagttgacgtagttgggttcttttgacttctgtcnctagaaccaaacaccaccgagacccctaaacccccatcactcatttagnggtctcactcgtccgcctgaaggtctctcacgntctcttcgcaagtcctacaagttcaggacctaacgacccgacctacccctaaactcggttcccgtcggtcgtacctacgtagtagacgtagtactactacttagtacgtacgtacgttaacgtttaacgttaaacgtcgcctaccgtacgttccggttagggtttccggttacgggccggtaaggaccaacgggtacgttccgtcccgttccgcgcgacgtccgtacgtcctccgtccccgttaccgtccgttccgtccg

SEQ ID NO: 356700 - DNA, 691 bp, Homo sapiens
  misc_feature: GZ8MTXP01D7I8Y.22.36.D03.1.454.CMB.2.raw
  modified_base (314)..(314): a, c, t, g, unknown or other
  misc_feature (314)..(314): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatcgtggacagtcgatcagctatttcctgcacgtcgggaaccaacagtgactagttcgggtctttgactctgtctctaggtaccaacaacacccacgacccaaacccccatcactctatttngtgtcactcgtcgcctgagcgtctctactatcgtcttcgtcaggtcctactaacgtccgtcggacctaaaccgtacccggtaccctacccctaaccctacgtccgtccggttcgggacctttacccgtagggttttacgaacgggtaccgtagttacttaaacgtttactttacgtgtaccgttaacgtttaacctttaaagtacggtacctaccgttaccgttcgttccgggtttgggtttccggggacggtaacgggtcccgttaacggtaaacggttccgtaacccggttcccttaccgggttccgttacccggaacccgaaccggtccgttccccggccccccgttacgggttcccttaacccgtttccccgg

SEQ ID NO: 356701 - DNA, 712 bp, Homo sapiens
  misc_feature: GZ8MTXP01CX729.22.36.D03.1.454.CMB.2.raw
  modified_base (670)..(670): a, c, t, g, unknown or other
  misc_feature (670)..(670): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacgagggtcctgggcccagtctcgccctgacccagcctgcctccgtgtctggatcatcgtgacagtcgatcgagtctactttcgcgactacggtacggaaccaacgtaggtacgtaacgttggttcggtttctttcgtacttcgtctctaccgtacgtaaccaaaccaacccaccgaaccccgaaccccaaaccccctataccgtactacttaactttgtcggtctacctaccgtcccggtccgtacctcggaacggtctcctaccctcgtacgttcgtccttaccgaacgtacgtctacgtacgtcgtacgaccaccgtaccgtccctacctactactcgtacggtcgtaccgtgttacggtagacgtacgtacttacttaacgttactcggtacgttacttaccgttaaccggttaagttccggcccttagttccggttaacggttcgggtttcggtaccgggtaggaaccggtccggttaagtacccggttcgttacccggtcggttaccgttcgcccggtaacccngggtccccttccgggccccgttagttcccgttcgttccccgg

SEQ ID NO: 356702 - DNA, 707 bp, Homo sapiens
  misc_feature: GZ8MTXP01BW9T7.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctgccctgacccagcctgcctccgtgtctggatcatcgtggacagtcgatcagtctatttcctgcacgtgggaaccaacgtagtgactagtttcgggttcttttgacttcgtcgtcctccgtacggtaacccaaacaaccaccccgacgacccccaaacccccccatccaattcctagtttagcggtctacctaccgtcggtccgccttgaggtacgtcctccgtacactcccgtcttccacgacggtcctaccgagtccgtcggaccaacgtcccgtacccttaccctaactcttccgtcggtaccggtcttacccggttagtttacggacggtaacgtacgttacttaacgtttacttacggggttctacgtttaaccgtttactttaaacgtaccggtcctacccgttaacgttccgtttacggttcggggtttacccggcgggaacgtacccgacggtacgttcggtaccccgttccgttccggttccgaccgtaacccgacggtcccgtaccccggtcccccgttagtcccttccgttccccg

SEQ ID NO: 356703 - DNA, 741 bp, Homo sapiens
  misc_feature: GZ8MTXP01EZ0H5.22.36.D03.1.454.CMB.2.raw
tcagacatacgcgtcacgaccggtgctcgatttagctgcgtcacgatctctcttgggggagagaggagcccagccctgggatttttcaggtgttttcatttggtgatcaggactgaacagagagaactcaccatggagtttgggctgaagtggtcttttgcttgtggtcttaattttaaaaggtgtcaagtgtgcggtagaaggtattggagtcgtgggggaggcgttggtacgacggccggggggtcctgacactctcctgtgcacgcctgtggtattcacagtcagcagctaagtgacctagtggtacggttcgggtccccgaccgacggtccgttacccggaaggggggtaacggggtttcggaccgtaagggggtttcgggggtacccggttacggggggtaattcggggaaagtttcggaagttcgggtacgacccaacgacccgtaaaccgtaacgcgtaaacggtacccgtcggggcggaaccgggggtcctcttaccacgttcaactcccgtaacaacggtacggtaaccgtaacttaaacccggaaaactaccgtaagtagaaactcgtaacaactaaagtcgtaacaccgtccacgacgaccggaccgtaaggccgtccggtccgtcttacgttcgacgttacgaaaccgtaacgttacccgttacgtttcggtttcgggacccgtccgggttacccggaccggttcggtaaccggggcccgtaacccggg

SEQ ID NO: 356704 - DNA, 724 bp, Homo sapiens
  misc_feature: GZ8MTXP01EJ856.22.36.D03.1.454.CMB.2.raw
  modified_base (186)..(186): a, c, t, g, unknown or other
  misc_feature (186)..(186): n is a, c, g, or t
  modified_base (222)..(222): a, c, t, g, unknown or other
  misc_feature (222)..(222): n is a, c, g, or t
  modified_base (398)..(398): a, c, t, g, unknown or other
  misc_feature (398)..(398): n is a, c, g, or t
  modified_base (469)..(469): a, c, t, g, unknown or other
  misc_feature (469)..(469): n is a, c, g, or t
  modified_base (476)..(476): a, c, t, g, unknown or other
  misc_feature (476)..(476): n is a, c, g, or t
  modified_base (615)..(615): a, c, t, g, unknown or other
  misc_feature (615)..(615): n is a, c, g, or t
  modified_base (625)..(625): a, c, t, g, unknown or other
  misc_feature (625)..(625): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctcgccctgacccagcctcgcctcgtntctggatcatctggacagtcgatcagtctatttccngaccagtacggaaccaagtgtacgtacttagttcgggttctttgacttcttcgtcctcctacggtaacccaaacaacccgaccccaaaccggaacccccaaaacccccctatcctaatcgtaatttagtggtctacgtacccgttccggtccgtccctagacggtacttcctaccnctacgtcctacttccaacgacggtcctacgtacgttccgacggtaaccaacgccgtacccctaacctaacncggttcncgtacggtcctaccggttaggttacgaacgggtacctacgttacttacttaacgttacgtcggttaacttaaccggttttaacccttaaagtaccggccttaccgtacgtttcgttaacggggttttgggttaaccggnggggtaaccnccggttaaacgggtaacgttccggtacccgttccgttacggttcacccgggtaacctacgtcccgtcccgtcccgttcggttaaccttccgtttccccg

SEQ ID NO: 356705 - DNA, 837 bp, Homo sapiens
  misc_feature: GZ8MTXP01EHYB7.22.36.D03.1.454.CMB.2.raw
  modified_base (185)..(185): a, c, t, g, unknown or other
  misc_feature (185)..(185): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggtctaattttaaaaggtgtnaagtgtggcggtgaaggtattggagtcgtgggggagcttggtacaggccggggggtcctgacactctcctgtgcagcctctggattcacagtcagcagacaatgacctaagtggaggttcggggtacccgccgtacggccgttaccggaagggggtaaaggggggttgtaccggtaagggggtttcgggggtccggttacggggggttaaggttaggggtaaaaggttgggtaacccgttgggggtacgacccaaaccgaaacctaaaacccgttaccgaacggtaacgtaaccgggttcccggttacggggaacggggggtcccctaccgtttcaacgttcccgtaattacccgttacccgaaaggaaacgggtaacccgtaaaccgtttaaacccgtaaaaaccgtaccggaaacttaagggtaaacaccgtttaacggggacctaaaagttcggttaaaccacggtaccctacgaccggtaccgggacccggtaacggacccggtacccgggggtcccttaacgttaacccgttttaggcgggttaacgaaaccggtaacggttaccctttacggtttacgggttttaaccgggcccggtccgggtacccggtagttacccggggtcggggttaacccggaacccgggg

SEQ ID NO: 356706 - DNA, 597 bp, Homo sapiens
  misc_feature: GZ8MTXP01C2L0J.22.36.D03.1.454.CMB.2.raw
  modified_base (307)..(307): a, c, t, g, unknown or other
  misc_feature (307)..(307): n is a, c, g, or t
  modified_base (324)..(324): a, c, t, g, unknown or other
  misc_feature (324)..(324): n is a, c, g, or t
tcagacatacgcgtcacgaccggtgctcgatttagctgcgtcacgatctctcttggggagctctgagagaggagccccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggtcttggtacaggccgggggggtccctgacactctcctgtgcagcctctggattcacagtcagcagcaatgcatgagtggcncagctcgagggtaggtncgagtgggtctcgggggattgggaagtggatgggtacaccaacaccgacgtaccgcgtagaccgtccggtgggacggggccgcttcagtcacgtctccgagacgacgaactaccgaaaacacgaggtacgaaatctaggaactaaagtcgtaacacgcctcgacgcccgaccggaacggaccgaccggacccgttctaaccgttcgttacggttcgacggtaaactacccgttaacttacggttttcgggacccgttccgggcccgtaaccgg

SEQ ID NO: 356707 - DNA, 608 bp, Homo sapiens
  misc_feature: GZ8MTXP01BRSR5.22.36.D03.1.454.CMB.2.raw
  modified_base (222)..(222): a, c, t, g, unknown or other
  misc_feature (222)..(222): n is a, c, g, or t
  modified_base (423)..(423): a, c, t, g, unknown or other
  misc_feature (423)..(423): n is a, c, g, or t
  modified_base (530)..(530): a, c, t, g, unknown or other
  misc_feature (530)..(530): n is a, c, g, or t
  modified_base (561)..(561): a, c, t, g, unknown or other
  misc_feature (561)..(561): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctcgccctgacccagcctgcctcgtgtctggatcatcgtggacagtcgatcagtctatttccngcacgtgggaaccaacgtagtgactagttggttactttgacttctgtcctacgtcgtaaccaacaaccacccacgacccaaacccccatcactctatttagtgtctcaccgtcgtccgcctagaggtactctcctcactcgtcttctacgacgtcctaccgaagtccgtacgaccaaccgtcccgtaccctaccctaaacncttcgcgtcggtcttaccgtagttacggacgtaccgtattacttacttactcggtcgtacttactttaactttaaagcgccgtaactcttcgttcgttggttccggnggtaacgtcgttacgacgttcgacccgttcncggttcaccgtccgtacgccgtcccgtcccttcgtccttcgttcccg

SEQ ID NO: 356708 - DNA, 641 bp, Homo sapiens
  misc_feature: GZ8MTXP01EAXM8.22.36.D03.1.454.CMB.2.raw
  modified_base (221)..(221): a, c, t, g, unknown or other
  misc_feature (221)..(221): n is a, c, g, or t
  modified_base (313)..(313): a, c, t, g, unknown or other
  misc_feature (313)..(313): n is a, c, g, or t
  modified_base (398)..(398): a, c, t, g, unknown or other
  misc_feature (398)..(398): n is a, c, g, or t
  modified_base (402)..(402): a, c, t, g, unknown or other
  misc_feature (402)..(402): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacgagggtcctgggcccagtctcgccctgacccagcctgcctcgtgtctggatcatctggacagtcgatcagctatttccngcacgtgggaaccaagagtgactagttgggttctttgactctgtctctagtaccaaacaacaccaacgaccaaacccccatcatctatttanggtctcacgtcgtcgcctacgaggatctacctcgatcgtacttcaacgacggctacaaagtcaggacaacgacgtcctaccaacnctcncgtcggtctaccgtagttacgagggacgtactaccttaactttattaaccttggtaaccgttagttttaaccctttaaaagttaccgggccgttaccctaacgtttcccgttgggtttacggtttcggcgggtaaacgtcgaaacccgggtaaattccggtaaacccggttccttaccgggcaccgaacccggttaaacggccttcccggcccccttcggtaacccttccgttttcccg

SEQ ID NO: 356709 - DNA, 717 bp, Homo sapiens
  misc_feature: GZ8MTXP01DEPO4.22.36.D03.1.454.CMB.2.raw
  modified_base (277)..(277): a, c, t, g, unknown or other
  misc_feature (277)..(277): n is a, c, g, or t
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggaaaacttttgcttgtggctattttaaaaggtgtcaagtgtgcggtgaaggtattggagtcgtgggggaggcttggtacaggccggggggtccctgacactctcctgtgcagcctctggattcacngtcagcagcaatgcatgagttggccncaggctcgaggaagggtncgagtggctcggggattggaagtgacgtggtgcctacgacctaaactacgtcgaaacgtaacgtcccggtagggacggggggtccctacgttacgaactccgtaacgtccgtacccgtaacggaacggaaccggtaacgtttaacccgaaaaaaccgaccggaaacgtaggtaaaacgttccgtacggggtaactaaaacgttaacggtaaccgtaaccggaccctcgaaccggacccggacccgtacgggaacccgtaaccgggtcccgttaacccgttaacgtttccgttacggttacggtaaccgtaaacgttacccgttcgtttaaacgtttttcgggaccccggtaaccggcccggtaaccgttaccggtcggggttcccgtaacccgggg

SEQ ID NO: 356710 - DNA, 633 bp, Homo sapiens
  misc_feature: GZ8MTXP01D07Z8.22.36.D03.1.454.CMB.2.raw
  modified_base (220)..(220): a, c, t, g, unknown or other
  misc_feature (220)..(220): n is a, c, g, or t
  modified_base (320)..(320): a, c, t, g, unknown or other
  misc_feature (320)..(320): n is a, c, g, or t
  modified_base (324)..(324): a, c, t, g, unknown or other
  misc_feature (324)..(324): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacgagggtcctgggcccagtctgccctgaccagcctcgcctcgtgtctggatcatctggacagtcgatcagtctatttcngcacgtcgggaaccaacgagtcgactgttcgggttctttggactctgtctctacgtacaacaaccaccacgacccaaacccccatccatctattatggtntacnccgtcgtccgcctcaggctcctctcagtcgtcttctacgcggtctacaacgtcgtaggactaacccgacgtcccctacccctaacgtactccgttcgtacgggtccctaccgttggtttacgaccggtacgtacgtaacctttatactttacggtactcttaacgtttacctttaaagtcgaccgtactacgttcgttacgttcggtttcggcggtaaggtcgaaccggtagttccgacccgttaccgttcggttccacggtaaccgacgggtcctcccgaccccgttcggtaaccttccgtttccccg

SEQ ID NO: 356711 - DNA, 519 bp, Homo sapiens
  misc_feature: GZ8MTXP02FV9RI.22.36.D03.1.454.CMB.2.raw
  modified_base (299)..(299): a, c, t, g, unknown or other
  misc_feature (299)..(299): n is a, c, g, or t
  modified_base (319)..(319): a, c, t, g, unknown or other
  misc_feature (319)..(319): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtcttttgactctgtctcctggtaccaacaacaccagcaaacccccatcatcattanggtgtcactcgtcggccctnaggagtctctcatcgcttctcagctcaagtctgcaacacgcctccctaacactctctgggctccagtttgaggacgagtctacttattactgctagtttacctttaaattacgcgcctacttctcgttggtttcggcggacggcaccgaagtcgaccgtccgtcggtcacgcccgaaggctcgcccctcggtcacttccg

SEQ ID NO: 356712 - DNA, 501 bp, Homo sapiens
  misc_feature: GZ8MTXP02FVAR7.22.36.D03.1.454.CMB.2.raw
  modified_base (245)..(245): a, c, t, g, unknown or other
  misc_feature (245)..(245): n is a, c, g, or t
tcagacatacgcgtcacgaccggtgctcgatttagctgcgtcacgatctctcttgggtttgggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccgcttcatcatctccagagacgattccgaaaacncagtgaatctgcaaatgtacagcctcagcgccgaggacacggccgtctacttctgtgcgaaagacctctattttgggccgcggccgacctactggggccaggggcaccctggtcaccgtctcttcagcctcaccaagggcccatcgctcccctgcgccctgctccagacgcacctccgagagcacagccggccctgggctgcctgtcaaggactacttccacgcgtatcgtctgagcgggctggcaaggcgcatag

SEQ ID NO: 356713 - DNA, 543 bp, Homo sapiens
  misc_feature: GZ8MTXP02H3L9L.22.36.D03.1.454.CMB.2.raw
  modified_base (382)..(382): a, c, t, g, unknown or other
  misc_feature (382)..(382): n is a, c, g, or t
  modified_base (393)..(393): a, c, t, g, unknown or other
  misc_feature (393)..(393): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttgggccgccaggctccgaggggaaggggttgcaggtgggtctcggggattgggaagtgacgtggtgccacacactacgcagactccgngacgggggccncttcatcatctccagagacgacttaccgaaaacacagtagaatctagacaaatagtacagcctcagcgaccgaggacacggccgtctacttctgtcgacgaacgacctctacgttttcggccgtcggccgactacgtcgggaccgacggg

SEQ ID NO: 356714 - DNA, 525 bp, Homo sapiens
  misc_feature: GZ8MTXP02IUDZC.22.36.D03.1.454.CMB.2.raw
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
tcagacatacgcgtcacgaccggtgctcgatttagctgcgtcacgatctctcttgggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcattcctgcactgggaccaacagtgacattgggtcttttgactctgtctcctggtaccaacaacacccaggcaaaccccccatcatcattangtntcactcgtcggcctcagagtctctccatcgcttctcaggctccaagtctggcacacgcctccctaacatctctgggctcccagtttgagacgagtctacttattactgctagttacctttaaattacggctcctactctcgttggttttcggcggtaggtcaccggaagtcgaccgtctcggtcacgcccgtaaggcctcgccccctcggcctacgtcttccgg

SEQ ID NO: 356715 - DNA, 513 bp, Homo sapiens
  misc_feature: GZ8MTXP02FWXGV.22.36.D03.1.454.CMB.2.raw
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattccgaaaacncagtgaatctgcaaatgtacagcctcagcgccgaggacacggcgtctactctgtgcgaaagacctctatttttgggccgcggccgactactggggccagggcaccctggtcaccgtctcttcagcctccacccaagggcccatcggtccttccccctggccgccctgcctccaggcgccacctccgagacgcacgagcggccctgggctgcctggtcaaggactacttcacgcgtactcgtctgacgcggctggcaggcncanag

SEQ ID NO: 356716 - DNA, 529 bp, Homo sapiens
  misc_feature: GZ8MTXP02JZVHJ.22.36.D03.1.454.CMB.2.raw
  modified_base (344)..(344): a, c, t, g, unknown or other
  misc_feature (344)..(344): n is a, c, g, or t
  modified_base (365)..(365): a, c, t, g, unknown or other
  misc_feature (365)..(365): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacacacccaggcaaacccccactcatcatttatggtgtcactcgtcggccctcaggagtctcctcatcgcttcncaggctccaagtctggcaacncggccctccctaaaccatcctctgggctcccagtttgagaccgagtctacttattactgctagttcctttaaaattgcgtccactctcgtggtttcggcgtacggcaccggaagttacccgtcctcgggtcacgccccaaggctcgccccctggtccactctcg

SEQ ID NO: 356717 - DNA, 561 bp, Homo sapiens
  misc_feature: GZ8MTXP02GEQRB.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctggacactctcctgtgcagcctctggattcacagtcagcagcaatgccatgagttgggtacgccaggctccgaggggaaggggttgcgaggtggggtcgtcggggattgggaagtgatggtgccacacactacgcagactccggtgacgggggccgcttcatcatctaccagagacgacttaccgaaaacacagtagaaatctagacaaatgtaacagccctcacgcgaccgaggacgacggccgtactactcgtgtgacgaaacgtaccttcttacgttttcgggccgcggaccgacgtacgtcggggaccgacggg

SEQ ID NO: 356718 - DNA, 501 bp, Homo sapiens
  misc_feature: GZ8MTXP02FW4AO.22.36.D03.1.454.CMB.2.raw
  modified_base (406)..(406): a, c, t, g, unknown or other
  misc_feature (406)..(406): n is a, c, g, or t
  modified_base (418)..(418): a, c, t, g, unknown or other
  misc_feature (418)..(418): n is a, c, g, or t
  modified_base (430)..(430): a, c, t, g, unknown or other
  misc_feature (430)..(430): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaaagacctctattttgggccgcggccgacctactggggccaggggcaccctggtcaccgtctcttcagcctccaccaaggcccatcgtctcccctgcnccctgctccagngcacctccgagngcacagccgccctgggctgcctgtcaaggctactccacgcgtatcgtctgagcgggctggcaggcgcatag

SEQ ID NO: 356719 - DNA, 533 bp, Homo sapiens
  misc_feature: GZ8MTXP02F9ER2.22.36.D03.1.454.CMB.2.raw
  modified_base (391)..(391): a, c, t, g, unknown or other
  misc_feature (391)..(391): n is a, c, g, or t
  modified_base (474)..(474): a, c, t, g, unknown or other
  misc_feature (474)..(474): n is a, c, g, or t
tcagacatacgcgtcacgaccggtgctcgatttagctgcgtcacgatttctcttgggggagagaggagcccagccctgggattttcaggtgtttcatttggtgatcaggactgaacagagagaactcaccatggagtttgggctgaagtggcttttgcttgtggctattttaaaaggtgtcaagtgtgcggtgaaggtattggagtctgggggaggcttggtacagccggggggtccctgacactctcctgtgcagcctctggattcacagtcagcagcaatgccatgagttgggtccgccagggctccgaggggaaggggttgcgaggtgggtctcgggggattggaagtgatggtgccagacactacgcagactccggtgagggggccncgttcatcatctccagagacgataccgaaaacacagtagaatctgacaatgtacagcctcagcgcgagacacgcgtctactcngtcgcgaaacgacctactattttcggccgtcggccgacgtacgtcgggaccgacggccg

SEQ ID NO: 356720 - DNA, 554 bp, Homo sapiens
  misc_feature: GZ8MTXP02IBJKS.22.36.D03.1.454.CMB.2.raw
  modified_base (366)..(366): a, c, t, g, unknown or other
  misc_feature (366)..(366): n is a, c, g, or t
  modified_base (396)..(396): a, c, t, g, unknown or other
  misc_feature (396)..(396): n is a, c, g, or t
  modified_base (458)..(458): a, c, t, g, unknown or other
  misc_feature (458)..(458): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccgggggggtccctgacactctcctgtgcagcctctggattcacagtcagcagcaaatgccatgagttgggccgccaggctccgaggggaaggggttgcaggtggggtcgtcggggattgggaagtgatggtgccanacactacgcagactccggtgacgggggccncttcatcatctccagagacgattaccgaaaacacagtagaaatctagacaaatgtacagccncacgcgaccgaggacgacggccgtctacttctgtagacgaaacgaccttacttagttttcgggccgtccggccgacgtacgtcggggccgacgggg

SEQ ID NO: 356721 - DNA, 528 bp, Homo sapiens
  misc_feature: GZ8MTXP02H9N21.22.36.D03.1.454.CMB.2.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaanagtgacattgggtcttttgactctgtctcctggtaccaacaacacccaggccaaacccccaactcatcatttatggtgtcactcgtcggccctcaggagtctcctcatcgcttctcaggctccaagtctgcaacacgccctccctaacatctctgggctccagtttgaggacgagtctacttattactgtctagttaccttaaattgacgccaactctcgtgttttcggcggtacggctaccgaagtcgaccgtctcggtcacgcccaaggcctcgccccctcggtactacgtccg

SEQ ID NO: 356722 - DNA, 550 bp, Homo sapiens
  misc_feature: GZ8MTXP02HN5QT.22.36.D03.1.454.CMB.2.raw
  modified_base (368)..(368): a, c, t, g, unknown or other
  misc_feature (368)..(368): n is a, c, g, or t
  modified_base (395)..(395): a, c, t, g, unknown or other
  misc_feature (395)..(395): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccggggggtccctgacactctcctgtgcagcctctggattcacagtcagcagcaatgccatgagttgggtccgccaggctccgaggggaaggggttgcgagtggggtctcggggattgggaagtgatgggtgccacanactacgcagactccggtgagggggccnttcatcatctaccagagacgacttaccgaaaacacagtagaatctagacaaatgtacagcctcacgcgccgaggacgacgccgtactacttctcgtcgacgaacgaccttacttacgttttcggccgcggccgacgtacgtcggggaccgacggg

SEQ ID NO: 356723 - DNA, 549 bp, Homo sapiens
  misc_feature: GZ8MTXP02HFGHG.22.36.D03.1.454.CMB.2.raw
  modified_base (217)..(217): a, c, t, g, unknown or other
  misc_feature (217)..(217): n is a, c, g, or t
  modified_base (250)..(250): a, c, t, g, unknown or other
  misc_feature (250)..(250): n is a, c, g, or t
  modified_base (528)..(528): a, c, t, g, unknown or other
  misc_feature (528)..(528): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattaccgaaaacncagtgaatctgcaaatgtacagcctcagcgccgaggacacggccgtctacttctgtgcgaaagacctctatttttgggccgcggccgacctacgtggggccaggggcacccgtggtcaccgtctcttcagcctccacccgaacgggcccagtccggtccttcccccgtgggcccgcccctcgcctcccgaggacgccaccctccgagacgccacacgccggcccctgggcctcggccgtggtcaaacgggactaccgttccacgcgtacgtcgtctgngcgggctcggcaaggcgcatg

SEQ ID NO: 356724 - DNA, 532 bp, Homo sapiens
  misc_feature: GZ8MTXP02FUBWG.22.36.D03.1.454.CMB.2.raw
  modified_base (305)..(305): a, c, t, g, unknown or other
  misc_feature (305)..(305): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggagcttggtacagccggggggtccctgacactctcctgtgcagcctctggattcacagtcagcagcaatgccatgagttgggtccnccaggctccgaggggaaggggttgcgaggtgggtctcggggattgggaagtgatgggtgccacacactacgccagactccggtgaggggccgcttcatcatctccagagacgattaccgaaaacacagtagaatctagacaaatgtacagcctcagcgcgaggacacggccgtctacttctgtcgacgaaacgacctacttacgttttcgggccgtcggaccgtacg

SEQ ID NO: 356725 - DNA, 518 bp, Homo sapiens
  misc_feature: GZ8MTXP02JCN41.22.36.D03.1.454.CMB.2.raw
  modified_base (363)..(363): a, c, t, g, unknown or other
  misc_feature (363)..(363): n is a, c, g, or t
  modified_base (391)..(391): a, c, t, g, unknown or other
  misc_feature (391)..(391): n is a, c, g, or t
  modified_base (478)..(478): a, c, t, g, unknown or other
  misc_feature (478)..(478): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccggggggtccctgacactctcctgtgcagcctctggattcacagtcagcagcaatgccatgagttgggtccgccaggctccaggggaaggggttgcagtgggtctcggggattggaagtgatggtgccncacactacgcagactccgtgaggggccncgttcatcatctccagagacgatccgaaaacacagtgaatctgacaaatgtacagcctcagcgccgaggacacggccgtctacttcngtcgcgaaagcctactacgttttcggccgcggccgtaacg

SEQ ID NO: 356726 - DNA, 519 bp, Homo sapiens
  misc_feature: GZ8MTXP02JNM6N.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctggtaccaacacaccagccaaaccccccatcatcattatggtgtaactcgtcggcctcagagtctctccatcgcttctcaggctccaagtctggcaacacggcctccctaaccatcctctgggctcccgagtttgaggtacgagtctacttattactgctagttcctttaaagtacggcgccacttctcgttggtttcggcggagtcacgagtcgaccgtctcggtcacgcccaaggctcgcccctggccactcttccg

SEQ ID NO: 356727 - DNA, 535 bp, Homo sapiens
  misc_feature: GZ8MTXP02H9AEN.22.36.D03.1.454.CMB.2.raw
  modified_base (366)..(366): a, c, t, g, unknown or other
  misc_feature (366)..(366): n is a, c, g, or t
  modified_base (399)..(399): a, c, t, g, unknown or other
  misc_feature (399)..(399): n is a, c, g, or t
  modified_base (416)..(416): a, c, t, g, unknown or other
  misc_feature (416)..(416): n is a, c, g, or t
  modified_base (505)..(505): a, c, t, g, unknown or other
  misc_feature (505)..(505): n is a, c, g, or t
  modified_base (528)..(528): a, c, t, g, unknown or other
  misc_feature (528)..(528): n is a, c, g, or t
  modified_base (533)..(533): a, c, t, g, unknown or other
  misc_feature (533)..(533): n is a, c, g, or t
tcagacatacgcgtcacgaccggtgctcgatttagctgcgtcacgatctctcttgggttttgggggtccctgacactctcctgtgcagcctctggattcacagtcagcagcaatgccatgagttgggtccgccaggctccagggaagggttgcagtgggtctcggggattggaagtgatggtgccacacactacgcagactccgtgagggccgcttcatcatctccagagacgattccgaaaacacagtgaatctgcaaatgtacagcctcagcgccgaggacacggccgtctactctgtgcgaaagacctctatttttgggccgcggccgacctactggggccaggggcaccctggtcaccgtcncttcagcctccaccaaggcccatcgtctccccngcgccctgctccagacncacctccgagacgcacacgccggcccgtgggcctcggccctcgggtcaaacgggcctaacctttcccgaacgtccggtatcgtctacgnggccgggtcacggccaaaggccncgtanag

SEQ ID NO: 356728 - DNA, 722 bp, Homo sapiens
  misc_feature: GZ8MTXP02JRXJM.22.36.D03.1.454.CMB.2.raw
  modified_base (223)..(223): a, c, t, g, unknown or other
  misc_feature (223)..(223): n is a, c, g, or t
  modified_base (254)..(254): a, c, t, g, unknown or other
  misc_feature (254)..(254): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgaggggaaggggttgcaggtgggtctcggggattggaagtgatggtgccacacactacgcagactccggtggacggggccncttcatcatctcagagacgattaccgaaacncagtagaatctgacaaatgtacacgcctacgacggccgaccggacggaccgaccgggtcccgttacttaccgttcgtacggtacggaacgtaaaacgtaccctttacgtttaacggtttttccggggccccggtccgggtaccgtacccgttaccggtcggggacccgacggggccctacccggttcggtccgtacccgttcttccgttaccaccgtccctacccgaaccgacgggccctacgtcccggtcccttccccgcggccctcccgtcgtcccgccgacgccgacccacccgtccggacgacgacccgaccggaccggcccggtcccggtcggggtcccttcgggaccgttacgggaaccgtaaccggtaccttaccggttacccgacggtcccggttaagtccgggttccggtacggaccggggtccgggtacggtacgggacggaacggcgacgacgtacg

SEQ ID NO: 356729 - DNA, 513 bp, Homo sapiens
  misc_feature: GZ8MTXP02HPAV5.22.36.D03.1.454.CMB.2.raw
  modified_base (216)..(216): a, c, t, g, unknown or other
  misc_feature (216)..(216): n is a, c, g, or t
  modified_base (410)..(410): a, c, t, g, unknown or other
  misc_feature (410)..(410): n is a, c, g, or t
  modified_base (422)..(422): a, c, t, g, unknown or other
  misc_feature (422)..(422): n is a, c, g, or t
  modified_base (424)..(424): a, c, t, g, unknown or other
  misc_feature (424)..(424): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattaccgaaaacacagtgaatctgcaaatgtacagcctcagcgccgaggacacggccgtctacttctgtgcgaaaagacctcttatttttgggccgcggccgacctacgtggggccaggggcaccctggtccaccgtctcttcagcctccacaaggcccatcgtctcccctgcncctgcctcagcncncctcgagagcacagccgccctggggctcgcctggtcaagggactacttccacgcgtactcgtctgacgcgggctcggcaaggcgcatag

SEQ ID NO: 356730 - DNA, 506 bp, Homo sapiens
  misc_feature: GZ8MTXP02JRA9D.22.36.D03.1.454.CMB.2.raw
  modified_base (404)..(404): a, c, t, g, unknown or other
  misc_feature (404)..(404): n is a, c, g, or t
  modified_base (504)..(504): a, c, t, g, unknown or other
  misc_feature (504)..(504): n is a, c, g, or t
tcagacatacgcgtcacgaccggtgctcgatttagctgcgtcacgatctctcttgggtttgggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccgcttcatcatctccagagacgattccgaaaacacagtgaatctgcaaatgtacagcctcagcgccgaggacacggccgtctacttctgtgcgaaagacctctatttttgggccgcggccgacctactggggccaggggcaccctggtcaccgtctcttcagcctccaccaagggcccatcgtctcccctgcnccctgctccagacgcacctccgagcgcacagcgccctgggctcgcctggtcaagggactacttccacgcgtactcgtcctgagcgggctggcaggcgcanag

SEQ ID NO: 356731 - DNA, 550 bp, Homo sapiens
  misc_feature: GZ8MTXP02H3DQE.22.36.D03.1.454.CMB.2.raw
  modified_base (396)..(396): a, c, t, g, unknown or other
  misc_feature (396)..(396): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttgggtacaggccgggggggtccctgacactctcctgtgcagcctctggattcacagtcagcagcaatgccatgagttgggtcccgccaggctccgaggggaaggggttgcaggtgggtctcggggattgggaagtgatgggtgccacacactacgcagactccggtgagggggcccnttcatcatctccagagacgacttaccgaaaacacagtagaaatctagacaaatgtacagcctcacgcgccgaggacgacggccgtctacttctgtcgacgaaacgaccttctagttttcgggccgcggccgacgtaccgtcggggaccgacggg

SEQ ID NO: 356732 - DNA, 553 bp, Homo sapiens
  misc_feature: GZ8MTXP02G41QR.22.36.D03.1.454.CMB.2.raw
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
  modified_base (320)..(320): a, c, t, g, unknown or other
  misc_feature (320)..(320): n is a, c, g, or t
  modified_base (359)..(359): a, c, t, g, unknown or other
  misc_feature (359)..(359): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtctttgactctgtctcctggtaccaacaacaccagaccaaacccccatcatcatttangtntcactcgtcggccctnaggagtctcctcatcgcttctcagctcaagtctgcaacncgccctacctacatctctggctcctagttgaaggtacgagtctaacttattactgtctacgtttacctttaaaagttacggctacctacttcgttcggtttcggttttccggcggtacggcctaaccggaacgtcgacccgtccgtcggtccacgcccgaacggtcctcgcccccgtcggtacctacgttcccg

SEQ ID NO: 356733 - DNA, 531 bp, Homo sapiens
  misc_feature: GZ8MTXP02I93OZ.22.36.D03.1.454.CMB.2.raw
  modified_base (215)..(215): a, c, t, g, unknown or other
  misc_feature (215)..(215): n is a, c, g, or t
  modified_base (466)..(466): a, c, t, g, unknown or other
  misc_feature (466)..(466): n is a, c, g, or t
  modified_base (498)..(498): a, c, t, g, unknown or other
  misc_feature (498)..(498): n is a, c, g, or t
tcagacatacgcgtcacgaccggtgctcgatttagctgcgtcacgatctctcttggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggtaccaacaacacccaggccaaaccccccatcatcattatggtgtcactcgtcggccctcaggagtctctcatcgcttctcaggctccaagtctggcaacacggcctccctaaaccatctctgggtcctcccgtagtttgacggtacgtagtctacttattactgctagttccctttaaagtagcgtccactctcgtggtttcgnggtagcgaccgagtcgtaccgtctcggtcacnccgaaggctcgcccctcggtcaccgtctcccgg

SEQ ID NO: 356734 - DNA, 619 bp, Homo sapiens
  misc_feature: GZ8MTXP02GM7RA.22.36.D03.1.454.CMB.2.raw
  modified_base (401)..(401): a, c, t, g, unknown or other
  misc_feature (401)..(401): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccgggggggtccctgacactctcctgtgcagcctctggattcacagtcagcagcaatgccatgagttgggtccgccgaggcctccgaggggaaggggttgcgaggtggggtcgtcggggattgggaagtgagtgggtgccacacactacgcagactccgtgacgggggccnctcatcatctccagacgacgacttaccgaaaacacagtgaaatctagactaaatcgtaacacgccctacgaacggccggacccggaacggacccgaaccggggtccccgttaccttaccgtttccgtaggttcggaacgtaaacgtaacccttcgtttaacgtttttcggggcccgacgggtccccgacgttaccggtcgggggacccgaaccggggg

SEQ ID NO: 356735 - DNA, 519 bp, Homo sapiens
  misc_feature: GZ8MTXP02IK0XD.22.36.D03.1.454.CMB.2.raw
  modified_base (216)..(216): a, c, t, g, unknown or other
  misc_feature (216)..(216): n is a, c, g, or t
  modified_base (360)..(360): a, c, t, g, unknown or other
  misc_feature (360)..(360): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtctttgactctgtctcctggtaccaacaacacccagcaaaccccccatcatcatttatggtgtcactcgtcggccctcaggagtctctccatcgcttctcagctcaagtctggcaacncggcctcctaaccatctctgggctcccagttgagacgagtctacttattactgctacgttcctttaaattacgcgtccactctcgttggttttcggcggtaggtcaccgagtcgaccgtctcggtacacgccgaagctcgcccctggtccactcttccg

SEQ ID NO: 356736 - DNA, 531 bp, Homo sapiens
  misc_feature: GZ8MTXP02GDAB2.22.36.D03.1.454.CMB.2.raw
  modified_base (303)..(303): a, c, t, g, unknown or other
  misc_feature (303)..(303): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccagccaaacccccatcatcatttangtgtcactcgtcggccctcaggagtctcctcatcgcttctcaggcctccaagtctgcaacacggccctaccctaacactctcgtgggcctccgagtttgacggtacgagtcttaacttattactgtactagtttacctttaaatacggctcctactctcgttggtttcggcggtagcacgaagtcgaccgtctcggtcagcccgaagctcgcccctcggtccactccg

SEQ ID NO: 356737 - DNA, 535 bp, Homo sapiens
  misc_feature: GZ8MTXP02G5SBG.22.36.D03.1.454.CMB.2.raw
  modified_base (302)..(302): a, c, t, g, unknown or other
  misc_feature (302)..(302): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccagccaaacccccatcatcatttangtgtcactcgtcggccctcaggagtctcctcatcgcttctcaggctccaatctgcaacacggccctccctaaccatctctggcctcctagtttgaggacgagtctacttattactgtcagtttccttaaatacgcgaccacttcgtcgttggtttcggcggtacggcgaccgaacgtcgacccgtccgtccgtcgacgcccgaacggcctcgcccccgtcggtccacttcccg

SEQ ID NO: 356738 - DNA, 554 bp, Homo sapiens
  misc_feature: GZ8MTXP02JENGW.22.36.D03.1.454.CMB.2.raw
  modified_base (457)..(457): a, c, t, g, unknown or other
  misc_feature (457)..(457): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggccaaaccccccaactcatcatttatggtgtcactcgtcgcccctcaggagtctcctcatcgcttctcaggctccaagtctggcaacaccggccctaccctaacatctctgggctccaggtttgacggaacgagttcttaacttattactgtctagtttacctttaaaattgggccncctaacttcgttcggttcgggtttcggacggacggccaaccggtaagtcgacccgtcctacggtcagcccgaaggcctcggccccctggtcacttcc

SEQ ID NO: 356739 - DNA, 526 bp, Homo sapiens
  misc_feature: GZ8MTXP02FY6BR.22.36.D03.1.454.CMB.2.raw
  modified_base (522)..(522): a, c, t, g, unknown or other
  misc_feature (522)..(522): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaacccccccaactcatcatttatggtgtcactcgtcggccctcaggagtctctcatcgcttctcaggctccaagtctggcaacacggccctccctaaaccatctctgggctccagtttgaggacgagtctacttattactgctagtttacctttaaattacggctccactctcgtggtttcgcggtaggcaccgaagtgaccgtctcggtcacgccgaagctcgccccctcggtccnctcg

SEQ ID NO: 356740 - DNA, 540 bp, Homo sapiens
  misc_feature: GZ8MTXP02I333I.22.36.D03.1.454.CMB.2.raw
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
  modified_base (444)..(444): a, c, t, g, unknown or other
  misc_feature (444)..(444): n is a, c, g, or t
  modified_base (510)..(510): a, c, t, g, unknown or other
  misc_feature (510)..(510): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattccgaaaacncagtgaatctgcaaatgtacagcctcagcgccgaggacacggccgtctacttctgtgcgaaagacctcttattttcgggccgcggccgacctacgtggggccagggccacccgtggtccaccgtctcttcacgcctccacccaaacgggcccagtccggtccttccccctgggcccgcccctgcctcccgaggacncaccctccgagacgccacgacgccggcccgtgggctcgcctggtcaaggctacgttccacgcgtancgtctgacgcgggctggcaaggcgacatag

SEQ ID NO: 356741 - DNA, 528 bp, Homo sapiens
  misc_feature: GZ8MTXP02IM4QB.22.36.D03.1.454.CMB.2.raw
  modified_base (390)..(390): a, c, t, g, unknown or other
  misc_feature (390)..(390): n is a, c, g, or t
  modified_base (422)..(422): a, c, t, g, unknown or other
  misc_feature (422)..(422): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaggtgtcaagtgtgcggtgaaggtattggagtctgggggaggcttggtacaggccggggggtccctgacactctcctgtgcagcctctggattcacagtcagcagcaatgccatgagttggtccgccaggctccgaggggaggggttgcgagtgggtctcggggattggagtgatggtgccacgacactacgcagactccgtgaggggcncttcatcatctccagacgacgataccgaaaanacagtagatctgacaaatgtaacagcctcacgcgccgacggacacggccgtctacttctcgtcgacgaaacgcctacgttacgttttcggccgtcggccgtaaccg

SEQ ID NO: 356742 - DNA, 572 bp, Homo sapiens
  misc_feature: GZ8MTXP02F29G7.22.36.D03.1.454.CMB.2.raw
  modified_base (279)..(279): a, c, t, g, unknown or other
  misc_feature (279)..(279): n is a, c, g, or t
  modified_base (396)..(396): a, c, t, g, unknown or other
  misc_feature (396)..(396): n is a, c, g, or t
tcagacatacgcgtcacgaccggtgctcgatttagctgcgtcacgatctctcttgggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcgttggtacgagggcccgggggtcctgacactctcctgtgcagcctctggattcacngtcagcagcaatgccatgagttggccgcaggctccgagggagggttgcgaggtggtctcggggattgggaagtgagtggtcgccacacactacgcagacctccggtgacggggcccncgttcatcgatctaccagacgacgacttaccgaaaacacgtagtagaacttcgtagaacaaaagtgtaacgacgcctcgaagccgacgacggaccgaccggccgtactacttcgtacggtcgaacgtaaacgtcccttacgtttacggttttcgggccgtaccgggccgtaaccgg

SEQ ID NO: 356743 - DNA, 540 bp, Homo sapiens
  misc_feature: GZ8MTXP02FU4SB.22.36.D03.1.454.CMB.2.raw
  modified_base (303)..(303): a, c, t, g, unknown or other
  misc_feature (303)..(303): n is a, c, g, or t
  modified_base (364)..(364): a, c, t, g, unknown or other
  misc_feature (364)..(364): n is a, c, g, or t
  modified_base (393)..(393): a, c, t, g, unknown or other
  misc_feature (393)..(393): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttgggtacaggccgggggggtccctgacactctcctgtgcagcctctggattcacagtcagcagcaatgccatgagttgggtccnccaggctccgaggggaaggggttacaggtgggtctcggggattgggaagtgatggtgccanacactacgcagactccgtgacgggggccnttcatcatctccagagacgattacccgaaaacacagtagaatctagacaaaatgtacagctcagcgccgaggacacgtccgctactctgtcgcgaaacgacctctagttttcgggccgcggaccgactacgtcgggccgacggaccg

SEQ ID NO: 356744 - DNA, 530 bp, Homo sapiens
  misc_feature: GZ8MTXP02HGLZ1.22.36.D03.1.454.CMB.2.raw
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (367)..(367): a, c, t, g, unknown or other
  misc_feature (367)..(367): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccactcatcatttanggtgtcactcgtcggccctnaggagtctcctcatcgcttctcaggctccaagtctgcaacncggcctccctaacatctctgggctcagtttgaggacgagtctacttattactgctagttcctttaaattggccgcactcgtcgttggttttacggcggtacggcaccggaagtcgaccgtccgtcggtcacgcccgaacggctcgcccctcggtccacttccg

SEQ ID NO: 356745 - DNA, 538 bp, Homo sapiens
  misc_feature: GZ8MTXP02GM9RM.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccagcaaaccccccactcatcatttatgtgtcactcgtcgccctcaggagtctcctcatcgcttctcagctccaagtctgcaacacgcctcccaacatctctggctccagtttgaggacagtctattattactgtctagtttacctttaaatcggcgtcctaactcttcgttgggttttcggcggtacggccaccggtaacgtcgaacccgttccgtacggtcctagcccgaaggcctccgccccctcggtccacttcccg

SEQ ID NO: 356746 - DNA, 599 bp, Homo sapiens
  misc_feature: GZ8MTXP02HRV9U.22.36.D03.1.454.CMB.2.raw
  modified_base (217)..(217): a, c, t, g, unknown or other
  misc_feature (217)..(217): n is a, c, g, or t
  modified_base (249)..(249): a, c, t, g, unknown or other
  misc_feature (249)..(249): n is a, c, g, or t
  modified_base (368)..(368): a, c, t, g, unknown or other
  misc_feature (368)..(368): n is a, c, g, or t
  modified_base (419)..(419): a, c, t, g, unknown or other
  misc_feature (419)..(419): n is a, c, g, or t
tcagacatacgcgtcacgaccggtgctcgatttagctgcgtcacgatctctcttgggttttgggggggtccctgacactctcctgtgcagcctctggattcacagtcagcaacaatgccatgagttgggtccgccaggctccgaggggaaggggttgcagtgggtctcggggattggaagtgatggtgccacacactacgcagactcgtgagggccncttcatcatctcagagacgattaccgaaaacncagtgaatctgcaaatgtacagcctcagcgcgagacacggcgtctactctgtgacgaaagacctctagttttcgggccgtcggccgactaccgtcggggaccagggccacccgtggtcnccgtctcttcacgcctccaccaacgggcccacgtccggtcccttcccccgnggcccgccctcgcctccacgggcgccacccgtccgagacgcacaggcccgcccgtcgggctcgccgtcggtacgaaacgggtaccttaccgttacccgaccggtccgttaagtcggttccggtacgggacgggccggggtccggtacggggaccggtaacgggccgacgtaacgtacgcg

SEQ ID NO: 356747 - DNA, 523 bp, Homo sapiens
  misc_feature: GZ8MTXP02GHEAA.22.36.D03.1.454.CMB.2.raw
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
  modified_base (441)..(441): a, c, t, g, unknown or other
  misc_feature (441)..(441): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctctggtaccaacaacacccagccaaacccccatcatcatttanggtgtcactcgtcggccctcaggagtctcctcatcgcttctcaggctccaagtctgcaacncgccctccctaacatctctggcctccagtttgaggacgagtctacttattactgtctagtttacctttaaatacggcnctactctcgtggtttcggcggtacgcacgtacgtcgaccgtccgtcggtcacgcccgaaggcctcgcccctcggtcacttcc

SEQ ID NO: 356748 - DNA, 525 bp, Homo sapiens
  misc_feature: GZ8MTXP02G2F8N.22.36.D03.1.454.CMB.2.raw
  modified_base (215)..(215): a, c, t, g, unknown or other
  misc_feature (215)..(215): n is a, c, g, or t
  modified_base (245)..(245): a, c, t, g, unknown or other
  misc_feature (245)..(245): n is a, c, g, or t
  modified_base (299)..(299): a, c, t, g, unknown or other
  misc_feature (299)..(299): n is a, c, g, or t
  modified_base (313)..(313): a, c, t, g, unknown or other
  misc_feature (313)..(313): n is a, c, g, or t
  modified_base (410)..(410): a, c, t, g, unknown or other
  misc_feature (410)..(410): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaagggttgcagtgggtctcggggattggaagtgatggtgccacacactacgcagactccgtgagggccnttcatcatctccagagacgattccgaaaancagtgaatctgcaaatgtacagcctcagcgccgaggacacggccgtctacttcngtgcgaaagacctntattttgggccgtcggccgacctacgtggggccagggcaccctggtccaccgtctcttcacgcctccaccaacggcccatcgtctcccctgcgcccngctccagcgcacctccgagcgcacacgcgcccgtgggctgcctcggtcaacggacctaccttccgacgtcgtaactcgtccgtgacgcgggtcgtcggcgaaaggccgacgacag

SEQ ID NO: 356749 - DNA, 573 bp, Homo sapiens
  misc_feature: GZ8MTXP02IH8TB.22.36.D03.1.454.CMB.2.raw
tcagacatacgcgtcacgaccggtgctcgatttagctgcgtcacgatctctcttgggttttgggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccgcttcatcatctccagagacgattacccgaaaacacagtgaatctgcaaatgtacagcctcagcgccgaggacacggccgtctactctgtgcgaaaagacctctagttttgggccgcggccgacctacgtggggccagggcaccctggtccaccgtctcttcacgcctccaccgaacgggcccacgtccggtcccttcccccgtggcccgcccctcgcctacccgaggacgccaacccgtccgagacgccacgacgcggccctggggctcggccctgggtacaaacgggtacctaccgttcccgaacgtccggtaatcgtcgtaggacggcgggtctcgggccaaagggccgacgaagcg

SEQ ID NO: 356750 - DNA, 558 bp, Homo sapiens
  misc_feature: GZ8MTXP02JM7LE.22.36.D03.1.454.CMB.2.raw
  modified_base (433)..(433): a, c, t, g, unknown or other
  misc_feature (433)..(433): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttgggtacagccgggggggtccctgacactctcctgtgcagcctctggattcacagtcagcagcaatgccatgagttgggtccgccaggctccgaggggaaggggttgcaggtgggtctcgggggattgggaagtgacgtgggtgccacacgactacgcaagactccggtgagggggcccgcttcatcatctccagagacgacttaccgaaaacncaagtgaaatcctagactaaaatcgtaacaagcctacacgccgccgaggacacggccgtctacttctgtcgacgaaacgacctcgttagtttcgggccgtcggccgactacgtcggggccacggg

SEQ ID NO: 356751 - DNA, 526 bp, Homo sapiens
  misc_feature: GZ8MTXP02IB6ZY.22.36.D03.1.454.CMB.2.raw
  modified_base (247)..(247): a, c, t, g, unknown or other
  misc_feature (247)..(247): n is a, c, g, or t
  modified_base (315)..(315): a, c, t, g, unknown or other
  misc_feature (315)..(315): n is a, c, g, or t
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
  modified_base (447)..(447): a, c, t, g, unknown or other
  misc_feature (447)..(447): n is a, c, g, or t
  modified_base (525)..(525): a, c, t, g, unknown or other
  misc_feature (525)..(525): n is a, c, g, or t
tcagacatacgcgtcacgaccggtgctcgatttagctgcgtcacgatctctcttaggttttgggggggtccctgacactctcctgtgcagcctctggattcacagtcagcagcaatgccatgagttgggtccgccaggctccagggaagggttgcagtgggtctcggggattggaagtgatggtgccacacactacgcagactccgtgagggccgcttcatcatctccagagacgattccgaaaacncagtgaatctgcaaatgtacagcctcagcgccgaggacacggccgtctacttctgtgcgaaagacctnttattttgggccgcggccgacctacgtggggccagggcacccgtgtcaccgtctccttcacgcctcacccaaggcccatccgtctcccccgtggccncctgacctccgaggacnccacctccgagacgcacngccggccctgggctcgcctggtcaaaggcctacttccgacgcgtactcgtctgagcgggctcggcaaggccgctaagng

SEQ ID NO: 356752 - DNA, 519 bp, Homo sapiens
  misc_feature: GZ8MTXP02FSAKD.22.36.D03.1.454.CMB.2.raw
  modified_base (249)..(249): a, c, t, g, unknown or other
  misc_feature (249)..(249): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacncagtgaatctgcaaatgtacagcctcagcgccgaggacacggccgtctacttctgtgcgaaagacctcttatttttgggccgcggccgacctacgtggggccaggggcaccctggtcaccgtctcttcagcctccaccaaggcccatcggtcttcccctgcgccctgctccaggcgcaccctccgagacgcacgagccggccctggggcctgccctggtcaaggactacttccacgcgtatcgtctgagcgggctggcaaggcgcagtag

SEQ ID NO: 356753 - DNA, 575 bp, Homo sapiens
  misc_feature: GZ8MTXP02GNAJ5.22.36.D03.1.454.CMB.2.raw
  modified_base (402)..(402): a, c, t, g, unknown or other
  misc_feature (402)..(402): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcttggtacgaggccgggggggtccctgacactctcctgtgcagcctctggattcacagtcagcagcaatgccatgagttgggtccgccgaggctccgaggggaaggggttgcgaggtgggtcgtcggggattgggaagtgagtgggtgccacacactacgcagacctccggtgacgggggccncttcatcatctccagacgacgacttaccgaaaacacagtagaaatctagacaaatagtaacagccctacgacgcgaccgaggaccgacggccgtctacttcgtcgtcgacgaaacgtacccttcttacgttttcgggcccgtccggccgacgtacggtcggggacccgacggg

SEQ ID NO: 356754 - DNA, 570 bp, Homo sapiens
  misc_feature: GZ8MTXP02JRPH6.22.36.D03.1.454.CMB.2.raw
  modified_base (367)..(367): a, c, t, g, unknown or other
  misc_feature (367)..(367): n is a, c, g, or t
  modified_base (393)..(393): a, c, t, g, unknown or other
  misc_feature (393)..(393): n is a, c, g, or t
  modified_base (424)..(424): a, c, t, g, unknown or other
  misc_feature (424)..(424): n is a, c, g, or t
  modified_base (489)..(489): a, c, t, g, unknown or other
  misc_feature (489)..(489): n is a, c, g, or t
  modified_base (513)..(513): a, c, t, g, unknown or other
  misc_feature (513)..(513): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctgacactctcctgtgcagcctctggattcacagtcagcagcaatgccatgagttgggtccgccaggatccaggggaaggggttgcgagtgggtctcggggattggaagtgactggtgccacganactacgcagactccgtgacggggccnctcatcatctcagagacgattaccgaaaacncagtgaaatctagacaaaatgtaacagcctcgagccgcgaaggacctacgggcctactacttccnggtacgacgaaaacggtacccttnttaacgttttcggggacccgtccggacccgtacttacggtcgggggaccaaccgggg

SEQ ID NO: 356755 - DNA, 564 bp, Homo sapiens
  misc_feature: GZ8MTXP02FJXWO.22.36.D03.1.454.CMB.2.raw
  modified_base (304)..(304): a, c, t, g, unknown or other
  misc_feature (304)..(304): n is a, c, g, or t
  modified_base (403)..(403): a, c, t, g, unknown or other
  misc_feature (403)..(403): n is a, c, g, or t
  modified_base (438)..(438): a, c, t, g, unknown or other
  misc_feature (438)..(438): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctgacactctcctgtgcagcctctggattcacagtcagcagcaatgccatgagttgggtccnccaggctccgaggggaaggggttgcgaggtggggtcgtcggggattggggaaacgtggatgggtgccacacactacgcagactccggtgacgggggccncttcatcatctaccagagacgacttaccgaaaacncagtagaatctgacaaatgtaacagcctacagccgccgaggacgacggccgtactacttctcgtgacgaaacgacctcgttagttttcgggccgtcggaccgactacggtcggggccgaaccgggg

SEQ ID NO: 356756 - DNA, 510 bp, Homo sapiens
  misc_feature: GZ8MTXP02HR44P.22.36.D03.1.454.CMB.2.raw
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
  modified_base (460)..(460): a, c, t, g, unknown or other
  misc_feature (460)..(460): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccgcttcatcatctccagagacgattccgaaaacacagtgaatctgcaaatgtacagcctcagcgccgaggacacggccgtctacttctgtgcgaaagacctctattttgggccgcggccgacctacgtggggccagggcacccctggtccaccgtctcttcagccctccaccaagggcccatcggtcttccccctgccgccctgctccaggacncacctccgagagcacngcggccctgggctgccngtcaaggctacttccacgcgtactgtctgagcggctggcaaggcgcatag

SEQ ID NO: 356757 - DNA, 536 bp, Homo sapiens
  misc_feature: GZ8MTXP02FQPRI.22.36.D03.1.454.CMB.2.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggtaccaacaacacccaggcaaaccccccaactcatcatttatggtgtcactcgtcggccctcaggagtctcctcatcgcttctcaggctccaagtctgcaacacggcctccctaaccatctctgggctccagtttgaggacgagtctacttattactgctagtttacctttaaaattacggcgtaccacttctcgttcggttttcgggcggtacggcacgaacgtgaccgtcctacggtcagcccgaacggctcgccccctcggtcacttcc

SEQ ID NO: 356758 - DNA, 509 bp, Homo sapiens
  misc_feature: GZ8MTXP02I3U0L.22.36.D03.1.454.CMB.2.raw
  modified_base (248)..(248): a, c, t, g, unknown or other
  misc_feature (248)..(248): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacncagtgaatctgcaaatgtacagcctcagcgccgaggacacggccgtctacttctgtgcgaaagacctctattttggccgcggccgacctactggggccagggcaccctggtcaccgtctcttcagcctccaccaagggcccatcggtctccccctgccgccctgctccagagccacctccgagagcacagccgccctgggctgccctggtcaaggactacttccacgccgtatcgtactgagcgggctggcaggcgcatag

SEQ ID NO: 356759 - DNA, 554 bp, Homo sapiens
  misc_feature: GZ8MTXP02H76A7.22.36.D03.1.454.CMB.2.raw
  modified_base (410)..(410): a, c, t, g, unknown or other
  misc_feature (410)..(410): n is a, c, g, or t
  modified_base (432)..(432): a, c, t, g, unknown or other
  misc_feature (432)..(432): n is a, c, g, or t
  modified_base (553)..(553): a, c, t, g, unknown or other
  misc_feature (553)..(553): n is a, c, g, or t
tcagacatacgcgtcacgaccggtgctcgatttagctgcgtcacgatctctcttgggttttgggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccgcttcatcatctccagagacgattccgaaaacacagtgaatctgcaaatgtacagcctcagcgccgaggacacggccgtcacttctgtgcgaaagacctctatttttgggccgcggccgacctacgtggggccaggggcacccgtggtcaccgtctccgttcagccctcaccaacgggcccatcggtccttcccccnggccgcccctgcctccaggacnccaccctccgagacgcacgacgcgccccgtgggcctgcccgtggtaccaacgggtactaccttcccgaacgtccggtattcgtaccgttgacggcgggcctgggaccaagggccgcgaagng

SEQ ID NO: 356760 - DNA, 546 bp, Homo sapiens
  misc_feature: GZ8MTXP02HCQ5Q.22.36.D03.1.454.CMB.2.raw
  modified_base (248)..(248): a, c, t, g, unknown or other
  misc_feature (248)..(248): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacncagtgaatctgcaaatgtacagcctcagcgccgaggacacggccgtctacttctgtgcgaaagacctctagttttggccgcggccgactacgtggggccagggcacccgtgtcaccgtctccttcacgcctccacccgacgggcccacgtccggtccttccccctggcccgcccctgcctcccgaggcgccaccgtccgacgacgccacgacgccggccctcgggctcgccgtcggtcaacggtactacttccgacgtcgtactcgtctggacgcgggctcggcgaaggcgacagtag

SEQ ID NO: 356761 - DNA, 636 bp, Homo sapiens
  misc_feature: GZ8MTXP02HEO91.22.36.D03.1.454.CMB.2.raw
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (322)..(322): a, c, t, g, unknown or other
  misc_feature (322)..(322): n is a, c, g, or t
  modified_base (342)..(342): a, c, t, g, unknown or other
  misc_feature (342)..(342): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctcgatcatctggacagtcgatcagcatttcctgcactgggaccaacagtgacattgggtcttttgactctgtctcctgtaccaacaacacccagaccaaaccccccatcatcatttangtntcactcgtcgccctnaggctctcctcatcgcttcncaggcctccaagtctggaccaacaccggccctaccctaaccactctcgtgggcctcctagtttgacggacgtagtcttacttattactggtcctagtttaccctttaaaagttcggccgtaccctacgttccgttcggttcgggtttttccgggccgggtaacggtcccgtaaccgggtaaacggttccggtaaccccggttccccgtaaccggggttccccaacggtaacccccgaaaggggtccccttaccggtaccccccccgtttcgggttcccctaaccctttccccgg

SEQ ID NO: 356762 - DNA, 526 bp, Homo sapiens
  misc_feature: GZ8MTXP02I6N7A.22.36.D03.1.454.CMB.2.raw
  modified_base (387)..(387): a, c, t, g, unknown or other
  misc_feature (387)..(387): n is a, c, g, or t
  modified_base (520)..(520): a, c, t, g, unknown or other
  misc_feature (520)..(520): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccagcaaaccccccaactcatcatttatggtagtcactcgtcggccctcaggagtctcctcatcgcttctcaggctccaagtctggcaacacggccctacctaaccatcnctgggctccagtttgagacgagtctacttattactgtctagttacctttaaatacggcacctactctcgtggtttcgcggtacgcaccgaagtcgaccgtctcggtcacgcccaaggctcgccccgtcggtcncttccg

SEQ ID NO: 356763 - DNA, 620 bp, Homo sapiens
  misc_feature: GZ8MTXP02JWGKO.22.36.D03.1.454.CMB.2.raw
  modified_base (411)..(411): a, c, t, g, unknown or other
  misc_feature (411)..(411): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcttggtacgaggccggggggtccctgaccactctcctgtgcagcctctggattcacagtcagcagcaatgccatgagtttcgggtcccgccaggctccgaggggtaagggttgcgagggtggggtcgtacggggatttgggaagtgagtgggtcgccacacactacgcaagcctccggtggacgggggcccncttcatccatcctccagacgacgacttaaccgaaaacacagtagaaatctagacaaatacgtacgacgcctacacggccgaccggacggaccgaccggcccgtacttaccgttcgtcggtacgaccggaaacgtacccgttactttacggttttccggggacccggtcccgggtacccgtaccgtaccggtccgggggaccgaccgggg

SEQ ID NO: 356764 - DNA, 583 bp, Homo sapiens
  misc_feature: GZ8MTXP02JNU9J.22.36.D03.1.454.CMB.2.raw
  modified_base (398)..(398): a, c, t, g, unknown or other
  misc_feature (398)..(398): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccggggggtccctgacactctcctgtgcagcctctggattcacagtcagcagcaatgccatgagttgggtccgccaggctccgaggggaaggggttgcgaggtgggtcgtcggggattggaagtgagtggtgccacacactacgcagacctccggtgacgggggcccncttcatcactcctccagagacgtactaccgaaaacacagtagaaatctagacaaatcgtacacgcctcgacgcgaccgaggacgacggccgttactacttctcgtacgacgtaaacgtaccgttacgttacgttttcgggcccggtccggtaccggtaccgtacggtccggggaccgaaccgggg

SEQ ID NO: 356765 - DNA, 538 bp, Homo sapiens
  misc_feature: GZ8MTXP02GS302.22.36.D03.1.454.CMB.2.raw
  modified_base (367)..(367): a, c, t, g, unknown or other
  misc_feature (367)..(367): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccggggggtccctgacactctcctgtgcagcctctggattcacagtcagcagcaatgccatgagttgggtccgcaggctccgaggggaaggggttgcgagtggggtctcggggattgggaagtgagtggtgccncacactacgcagactcgtgagggcgctcatcatctccagacgacgattaccgaaaacacaagtgaatctagacaaagtgtaacagaccctcacgcgcccgaggacgaccggccgtctacttctgtgacgaaacgacctacgttacgttttcgggaccgtcggaccgtaccg

SEQ ID NO: 356766 - DNA, 544 bp, Homo sapiens
  misc_feature: GZ8MTXP02HI3WP.22.36.D03.1.454.CMB.2.raw
  modified_base (367)..(367): a, c, t, g, unknown or other
  misc_feature (367)..(367): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggccaaaccccccaatcatcatttatggtgtcactcgtcggcccctcaggagtctcctcatcgcttctcaggctccaagtctgcaacncgccctccctaacatctctggctccagtttcgagacgagtctacttattactgtctagtttcctttaaaattggctacctacttcgttcgttggttttcggcggtaacggccaccgtaacgtcgacccgtccgtcggtccaagccccgaaaggcctcgccccctcggtccacttccg

SEQ ID NO: 356767 - DNA, 553 bp, Homo sapiens
  misc_feature: GZ8MTXP02F9X50.22.36.D03.1.454.CMB.2.raw
  modified_base (395)..(395): a, c, t, g, unknown or other
  misc_feature (395)..(395): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccgggggggtccctgacactctcctgtgcagcctctggattcacagtcagcagcaatgccatgagttgggtccgccaggctccgaggggaaggggttgcgagtgggtctcgggggattgggaagtgagtggtgccacacactacgcagactccgtggacgggggccncttcatcatctaccagagacgattaccgaaaacacagtgaaatctgacaaatgtaacagacctcagccgcgacggacacggccgtactacttctcgtgacgaaacgacctcttacgttttcggcccgtcggccgtacgtacggtcgggccgaccgggg

SEQ ID NO: 356768 - DNA, 584 bp, Homo sapiens
  misc_feature: GZ8MTXP02GYFCR.22.36.D03.1.454.CMB.2.raw
  modified_base (326)..(326): a, c, t, g, unknown or other
  misc_feature (326)..(326): n is a, c, g, or t
  modified_base (400)..(400): a, c, t, g, unknown or other
  misc_feature (400)..(400): n is a, c, g, or t
tcagacatacgcgtcacgaccggtgctcgatttagctgcgtcacgatctctcttgagggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcttggtacaggcccgggggggtccctgacactctcctgtgcagcctctggattcacagtcagcagcaatgccatgagttggccgccaggctccgaggggaagggttncgaggtgggtctcggggattgggaagtggatgggtgccacacactacgcaaggacctccggtggacgggggccncttcatcatctccagacgacgattacccgaaaacacaacgtagaatctagacaaatgtacacgcctacacgcgaccggacggacgaccggccgtacctacgttccgtagtcgacgaaacgtaccttacgttaacgtttttcggggcccggtccggtacccgaccgtacggtacggggaccccgg

SEQ ID NO: 356769 - DNA, 530 bp, Homo sapiens
  misc_feature: GZ8MTXP02IBAAM.22.36.D03.1.454.CMB.2.raw
  modified_base (247)..(247): a, c, t, g, unknown or other
  misc_feature (247)..(247): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccgcttcatcatctccagagacgattccgaaaacncagtgaatctgcaaatgtacagcctcagcgccgaggacacggccgtctacttctgtgcgaaagacctctatttttgggccgcggccgacctacgtggggccagggcaccctggtcaccgtctcttcacgcctccaccaagggcccatcggtccttccccctggccgcccctgctcccgaggcgccaccctccgagacgccacgacgccggccctggggctggactgggtcaagggtactacttccacgtccgtatcgtctgacgcgggctcggcaggcgcatg

SEQ ID NO: 356770 - DNA, 509 bp, Homo sapiens
  misc_feature: GZ8MTXP02GZFI0.22.36.D03.1.454.CMB.2.raw
  modified_base (247)..(247): a, c, t, g, unknown or other
  misc_feature (247)..(247): n is a, c, g, or t
  modified_base (408)..(408): a, c, t, g, unknown or other
  misc_feature (408)..(408): n is a, c, g, or t
  modified_base (504)..(504): a, c, t, g, unknown or other
  misc_feature (504)..(504): n is a, c, g, or t
tcagacatacgcgtcacgaccggtgctcgatttagctgcgtcacgatctctcttgggtttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacncagtgaatctgcaaatgtacagcctcagcgccgaggacacggccgtctacttctgtgcgaaagacctctatttttgggccgcggccgacctactggggccaggggcaccctggtcaccgtctcttcagcctccaccaagggcccatcggtctccccctgcnccctgctccagacgcacctccgagagcacagccggccctggggctgccctggtcaaggctacttccacgcgtatcgctgagcggctggccaaggcncatag

SEQ ID NO: 356771 - DNA, 620 bp, Homo sapiens
  misc_feature: GZ8MTXP02GT0UZ.22.36.D03.1.454.CMB.2.raw
  modified_base (220)..(220): a, c, t, g, unknown or other
  misc_feature (220)..(220): n is a, c, g, or t
  modified_base (234)..(234): a, c, t, g, unknown or other
  misc_feature (234)..(234): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (346)..(346): a, c, t, g, unknown or other
  misc_feature (346)..(346): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggactcatcgtggacagtcgatcagcatttccngcactgggaccaangtgacattggtctttacggctactgtctcctggtaccaacacaccaggaccaaacccccatcatcgtatttangtntcactcgtcgcctcgagtcgtctcctcatcgcttcncgaggcctaccgtaagtccgtagccaacgacggtccctaccctaaactacttccgtacgtcgggtccttacccgtaggtttcgaaccgggtacgtacgttaccgttaacgtttaacgttaccgtacggttaccgttaacggtttaccgtttaaaagttccggaccgtaccttacgtccgttcggttaaccggtttcggacggtacggtccacgtacgtcgtaccgtcgtacgtacacgtccgaacggtctacgtcccgtacgtaccacgttccg

SEQ ID NO: 356772 - DNA, 641 bp, Homo sapiens
  misc_feature: GZ8MTXP02G3L9Z.22.36.D03.1.454.CMB.2.raw
  modified_base (402)..(402): a, c, t, g, unknown or other
  misc_feature (402)..(402): n is a, c, g, or t
  modified_base (415)..(415): a, c, t, g, unknown or other
  misc_feature (415)..(415): n is a, c, g, or t
  modified_base (443)..(443): a, c, t, g, unknown or other
  misc_feature (443)..(443): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccgggggggtccctggacactctcctgtgcagcctctggattcacagtcagcagcaatgccatgagttgggtccgccaggctccgaggggaaggggttgcgaggtgggtcgtcggggattgggaagtgagtggtgccacacacctacgcacgacgtccggtggacgggggccncttcgatcattcnccagagacgactaccgaaacacgagtanaatctagacaaagtacgtacaacgcctacgaacggccgaccggacggaaccgtacccggtcccggttaccgttaccctttcgtacggttacggaccggtaaaacgtacccgtttaccgtttaaacggtttttccggggaaccccggtccggggtacccggtaccgtttacccggtacgggggtacccgaacccggggg

SEQ ID NO: 356773 - DNA, 563 bp, Homo sapiens
  misc_feature: GZ8MTXP02HNGLP.22.36.D03.1.454.CMB.2.raw
  modified_base (320)..(320): a, c, t, g, unknown or other
  misc_feature (320)..(320): n is a, c, g, or t
  modified_base (384)..(384): a, c, t, g, unknown or other
  misc_feature (384)..(384): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttgggtcttttgactctgtctcctgtaccaacaacaccagaccaaacccccatcatcatttatgtgtcactcgtcgcctnaggctctcctcatcgcttctcaggtcctccaagtctcggacaacaccggccctaccctaaaccnctctcgtcgggcctccgtaggtttgacggtacgagtcttactttacttactgtctagtttaccttaaatacggcacctactcgttcgttcgggtttcggcggtacggtccgacgtaacgtcggacccgtccgtacggtcacggcccgaaggcctccgccccgtcggtaccacctttccg

SEQ ID NO: 356774 - DNA, 522 bp, Homo sapiens
  misc_feature: GZ8MTXP02HB3L1.22.36.D03.1.454.CMB.2.raw
  modified_base (363)..(363): a, c, t, g, unknown or other
  misc_feature (363)..(363): n is a, c, g, or t
  modified_base (407)..(407): a, c, t, g, unknown or other
  misc_feature (407)..(407): n is a, c, g, or t
  modified_base (421)..(421): a, c, t, g, unknown or other
  misc_feature (421)..(421): n is a, c, g, or t
  modified_base (517)..(517): a, c, t, g, unknown or other
  misc_feature (517)..(517): n is a, c, g, or t
  modified_base (521)..(521): a, c, t, g, unknown or other
  misc_feature (521)..(521): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacacagactccgtgaggggccgcttcatcatctccagagacgattccgaaaacacagtgaatctgcaaatgtacagcctcagcgccgaggacacggccgtctacttctgtgcgaaagacctctattttggccgcggcgacctactggggccaggcaccctggcaccgtntcttcagcctccaccaagggcccatcggtccttccccctggccnccctgctccaggcncacctccgagagcacgagcggcccctgggcctcgcctggtcaaacgggtactaaccgttccaacgcgtactcgtcctgacgcggcgcggcgaggcncgang

SEQ ID NO: 356775 - DNA, 506 bp, Homo sapiens
  misc_feature: GZ8MTXP02HV7Q1.22.36.D03.1.454.CMB.2.raw
  modified_base (297)..(297): a, c, t, g, unknown or other
  misc_feature (297)..(297): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctggtaccaacaacaccagcaaaccccccatcatcattangtgtcactcgtcggccctcaggagtctctccatccgcttctcaggctccaagtctggccaacacggccctccctaaccatcctctgggcctccgtagttgagacgagtctacttatactgctagttcttaaatgcgcactctcgtgtttcgcgagcacgagtcgaccgtcgtcgtcacgccgaaggctcgcccctcggtcactctcccg

SEQ ID NO: 356776 - DNA, 601 bp, Homo sapiens
  misc_feature: GZ8MTXP02GQ50M.22.36.D03.1.454.CMB.2.raw
  modified_base (359)..(359): a, c, t, g, unknown or other
  misc_feature (359)..(359): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacgaggccggggggtccctggacactctcctgtgcagcctctggattcacagtcagcagcaatgccatgagttggccgcgaggctccgaggggagggttgcgaggtgggtcgtcggggattggaagtgagtggngccacacactacgcagctccgtggacggggccgcttcatcactctccgagacgacgacttaccgaaaactacgagtagaaactctacgactaaaagtcggtaacaacgcctacgacgaccgacggacggaccgacgggcccgttactacgttctacggtcgacgtaaaacgtcccttacgtttacgttttcggggcccgtaccgggtacccgtaccgtacggtcgggggacccaaccggggg

SEQ ID NO: 356777 - DNA, 527 bp, Homo sapiens
  misc_feature: GZ8MTXP02IQQDN.22.36.D03.1.454.CMB.2.raw
  modified_base (231)..(231): a, c, t, g, unknown or other
  misc_feature (231)..(231): n is a, c, g, or t
  modified_base (304)..(304): a, c, t, g, unknown or other
  misc_feature (304)..(304): n is a, c, g, or t
  modified_base (325)..(325): a, c, t, g, unknown or other
  misc_feature (325)..(325): n is a, c, g, or t
tcagacatacgcgtcacgaccggtgctcgatttagctgcgtcacgatctctcttgggtgggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgacattgggtctttgactctgtctcctggtaccaacaacaccaggccaaaccccccaactcatccatttanggtgtcactcgtcggcccctnaggagtctcctcatcgcttctcaggctccaagtctggccaacacggccctccctaaccactctctgggctcccagtttgaggacgagtctaacttattactgctagtttccttaaattacgcgccactctcgttggtttcgcggtagctacgaacgtgaccgtctcggtcagcccaacggctcgcccctcggtccacgttcc

SEQ ID NO: 356778 - DNA, 612 bp, Homo sapiens
  misc_feature: GZ8MTXP02HHP5A.22.36.D03.1.454.CMB.2.raw
  modified_base (303)..(303): a, c, t, g, unknown or other
  misc_feature (303)..(303): n is a, c, g, or t
  modified_base (402)..(402): a, c, t, g, unknown or other
  misc_feature (402)..(402): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcttggtacaggccgggggggtccctgacactctcctgtgcagcctctggattcacagtcagcagcaatgccatgagttgggccnccaggctccgaggggaaggggttgcgaggtgggtcgtcggggtattgggaagtgagtgggtgccacacactacgccagtactccggtggacgggggccncgttcatcatctccagagacgacttaccgaaaacacgagtagaatcgtagactaaatgtaacgacgcctacgacgccggacgacggaccgaccggcccgttcgtaccttgtcgtacggaaccgtaaacggtacccttcgttaacggtttttccgggcccggtaccgggttacccgaccggttaccggtccgggggacccgtaacccgggg

SEQ ID NO: 356779 - DNA, 505 bp, Homo sapiens
  misc_feature: GZ8MTXP02JUHGF.22.36.D03.1.454.CMB.2.raw
  modified_base (362)..(362): a, c, t, g, unknown or other
  misc_feature (362)..(362): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacacacccaggcaaaccccccactcatcattatgtgtcactcgtcggccctcaggagtctcctcatcgcttctcaggctcaagtctgcaacncgcctccctaaccatctctgggctccagttgagacgagtctacttattactgcagttccttaaatgcgcactctcgtgtttcgcggtagcacgagtcgaccgtccgtcggtcacgccgaaggctcgcccctcggtccacgtcc

SEQ ID NO: 356780 - DNA, 570 bp, Homo sapiens
  misc_feature: GZ8MTXP02F0RX8.22.36.D03.1.454.CMB.2.raw
  modified_base (303)..(303): a, c, t, g, unknown or other
  misc_feature (303)..(303): n is a, c, g, or t
  modified_base (400)..(400): a, c, t, g, unknown or other
  misc_feature (400)..(400): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctgacactctcctgtgcagcctctggattcacagtcagcagcaatgccatgagttgggccnccaggctccgaggggaaggggttgcgaggtgggtcgtcggggattgggaaagtgacgtgggtcgccacacactacgcagactccggtgacggggccncttcatcatcaccagagacgacttaccgaaaacacagtgaaatctagactaaatgtacagccctacgacgcgaccgaggacgacggtccgtactacttcgtagtacgacgaaacgtaccttcgttacgtttcgggccgtacggcccgtacgtacggtcggggaccacggg

SEQ ID NO: 356781 - DNA, 520 bp, Homo sapiens
  misc_feature: GZ8MTXP02HFBIA.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttgggtacaggccggggggtccctgacactctcctgtgcagcctctggattcacagtcagcagcaatgccatgagttggtccgccaggctccgaggggaaggggttgcagtgggtctcggggattgggaagtgatggtgccacacactacgcagactccgtgaggggcgcttcatcatctccagagacgataccgaaaacacagtagaatctgacaaatgtacagcctcagcgccgaggacacggccgtctacttctgtgacgaaagcctactacttttcggccgtcggccgtacg

SEQ ID NO: 356782 - DNA, 629 bp, Homo sapiens
  misc_feature: GZ8MTXP02HKKSW.22.36.D03.1.454.CMB.2.raw
  modified_base (367)..(367): a, c, t, g, unknown or other
  misc_feature (367)..(367): n is a, c, g, or t
  modified_base (399)..(399): a, c, t, g, unknown or other
  misc_feature (399)..(399): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggcttaattttaaaaggtgtcaagtgtgcggtgaaggtatggagtcgtgggggagcttggtacaggccggggggtccctgacactctcctgtgcagcctctggattcacagtcagcagcaatcgccatgagttggtccgccgaggctccgaggggagggttgcgaggtgggtcgtcggggagttgggaagtgagtggtgccanacactacgcagactccggtgacgggggtcccncgttcatcactctccgagacgacgtaacttaccgaaaacacgagtacgaaatctagactaaagtcgtaacacgccctacgacgccgaccggaacggaccgaaccggggtcccgttacgtacctttcgtacggtacggaccggtaaaaacgtcccttacgtttaacggtttttccggggcccggtaccgggacccggtaacgttaccggttcgggggacccgaaccggggg

SEQ ID NO: 356783 - DNA, 568 bp, Homo sapiens
  misc_feature: GZ8MTXP02G09B1.22.36.D03.1.454.CMB.2.raw
  modified_base (409)..(409): a, c, t, g, unknown or other
  misc_feature (409)..(409): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttgggtacaggccgggggggtccctgacactctcctgtgcagcctctggattcacagtcagcagcaatgccatgagttgggtccgccaggctccgaggggaaggggttgcaggtgggtctcggggattgggaagtgatgggtgccacacactacgcagacctccggtgacgggggccgcttcgatcattcnccagagacgacttaccgaaaacacagtagaaatctagacaaatgtacaagccctacgacgcgccggaggaccacggccgtcgtacttcgtgtcgacggaaacgtacctcttagttttcgggccgtccggccgtacgtaccggtcgggggacctacgggg

SEQ ID NO: 356784 - DNA, 532 bp, Homo sapiens
  misc_feature: GZ8MTXP02JLN0L.22.36.D03.1.454.CMB.2.raw
  modified_base (305)..(305): a, c, t, g, unknown or other
  misc_feature (305)..(305): n is a, c, g, or t
  modified_base (343)..(343): a, c, t, g, unknown or other
  misc_feature (343)..(343): n is a, c, g, or t
  modified_base (363)..(363): a, c, t, g, unknown or other
  misc_feature (363)..(363): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctgtaccaacaacaccagaccaaacccccactcatcatttatggtntcactcgtcggccctcaggacgtctcctcatcgcttcncacgctccaagtctgcaacncgccctaccaccatctctggctctagttgacggactagtcttattattactgtctagtttacctttaaatcggctcctactcgttcgttggtttcggcggtacggcaccggaagtcgaccgtcctcggtacacgtcccgaaggcctacgcccccgtcggtccacttccg

SEQ ID NO: 356785 - DNA, 593 bp, Homo sapiens
  misc_feature: GZ8MTXP02I8P60.22.36.D03.1.454.CMB.2.raw
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccncttcatcatctccagagacgattccgaaaacncagtgaatctgcaaatgtacagcctcagcgccgaggacacggccgtctacttctgtgcgaaagcctctattttggccgcggccgactactggggccaggggcacccgtgtcaccgtctcttcacgcctccaccaacgggcccatccggtccttccccctggccgcccctgcctccaggacgtccaccctccggacgacgccacgacgcccggcccgtgggggccttcggcccgttcgggtaccaaacggggtacccttaccgtttacccgaccggtaccggttatccggtttaccggtcggacgggtccgggtccgtacgggaccgaacgggccgtacgagtacg

SEQ ID NO: 356786 - DNA, 571 bp, Homo sapiens
  misc_feature: GZ8MTXP02GVC9L.22.36.D03.1.454.CMB.2.raw
  modified_base (303)..(303): a, c, t, g, unknown or other
  misc_feature (303)..(303): n is a, c, g, or t
  modified_base (398)..(398): a, c, t, g, unknown or other
  misc_feature (398)..(398): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccgggggggtccctgacactctcctgtgcagcctctggattcacagtcagcagcaatgccatgagttgggccncgaggctccgaggggaggggttgcaggtgggtcgtcggggagttgggaagtgacgtgggtgccacacactacgcagactccggtgacgggggccncttcatcatcctccagacgacgacttaccgaaaacacagtagaatctagactaaaatgtaacagccctacacgcgccggacggaccgacggccgtctacgttctgtacgacgaaacgtaccttcgttacgtttcgggcccgtcggacccgacgtacggtcgggaccgtacggg

SEQ ID NO: 356787 - DNA, 525 bp, Homo sapiens
  misc_feature: GZ8MTXP02JNRP7.22.36.D03.1.454.CMB.2.raw
  modified_base (232)..(232): a, c, t, g, unknown or other
  misc_feature (232)..(232): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaanagtgacattgggtctttgactctgtctcctgtaccaacaacacccaggaccaaaccccccactcactcatttatgtgtcactcgtcgccctcaggagtctcctcatcgcttctcaggctccaagtctcgacaacacgccctaccctaaccatctcgtggcctccagttgagacgatcttactattactgctagtttacctttaaagtacgcgcctactctcgttggtttcgcggacgcaccgagtacgcccgtctcggtcagcccgaagctccgcccccgtgtaccactcccg

SEQ ID NO: 356788 - DNA, 582 bp, Homo sapiens
  misc_feature: GZ8MTXP02GKU6R.22.36.D03.1.454.CMB.2.raw
  modified_base (324)..(324): a, c, t, g, unknown or other
  misc_feature (324)..(324): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggaccaaaccccccatcatcatttatgtgtcactcgtcggccctnaggagtctcctcatcgcttctcaggcctccaagtctgcaacacggccctaccctaacactctcgtggctccagtttgaggacagtctacttatactgctagtttacctttaaagtacgcgtacctacttcgttcggttggtttcgggacggtacggtccgaaccggtaaacggtcggtaacccggttcccgttacggtccgtaacggaaccccgtaaacgggtccttccggtccccccgttcggtcctacctttcccg

SEQ ID NO: 356789 - DNA, 709 bp, Homo sapiens
  misc_feature: GZ8MTXP02HAEGQ.22.36.D03.1.454.CMB.2.raw
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctgtaccaacacaccagaccaaaccccccatcatcattangtntcactcgtcggccctcaggacgtctcctcacttccgcttctcacgggtcctccaaagtcctagggccaaacgaccgggtcccctacccctaaaccacttcctcgtcgggtcccttccgtaggtttcgaacggtacgtacgttacttaactttattaacctggtaccttaacggttttaccctttaaaagttacgggtcctaccccttaacgttccgttaccgggtttcgggtttttaccgggcccggggttaaaacggccgtaaaccccgggtaaggttacccgggtaaacccggtttaccccgtacccggggtttccgaacccggaacccccggttaaaacggggtccccgttacccggtaccccccccggtttaccggggttacccgtaccccttttccccgg

SEQ ID NO: 356790 - DNA, 589 bp, Homo sapiens
  misc_feature: GZ8MTXP02JY402.22.36.D03.1.454.CMB.2.raw
  modified_base (249)..(249): a, c, t, g, unknown or other
  misc_feature (249)..(249): n is a, c, g, or t
  modified_base (439)..(439): a, c, t, g, unknown or other
  misc_feature (439)..(439): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacncagtgaatctgcaaatgtacagcctcagcgccgaggacacggccgtctacttctgtgcgaaagacctctattttcgggccgcggccgacctacgtggggccaggggcaccctggtccaccgtctcttcagccctccaccgaacgggcccatccggtccttcccccgtggcccgcccctgcctccaggacnccacctccgagacgcacgacgccggcccgtggggcctcggcccgtgggtaccaaaacgggtacccttaacgttccccgaacggtcccgttaagttcggtccttgggacggccggggcttcggggacgaacggggcggtaccgaactacgg

SEQ ID NO: 356791 - DNA, 520 bp, Homo sapiens
  misc_feature: GZ8MTXP02IF7XA.22.36.D03.1.454.CMB.2.raw
  modified_base (183)..(183): a, c, t, g, unknown or other
  misc_feature (183)..(183): n is a, c, g, or t
  modified_base (209)..(209): a, c, t, g, unknown or other
  misc_feature (209)..(209): n is a, c, g, or t
  modified_base (239)..(239): a, c, t, g, unknown or other
  misc_feature (239)..(239): n is a, c, g, or t
  modified_base (265)..(265): a, c, t, g, unknown or other
  misc_feature (265)..(265): n is a, c, g, or t
  modified_base (292)..(292): a, c, t, g, unknown or other
  misc_feature (292)..(292): n is a, c, g, or t
  modified_base (400)..(400): a, c, t, g, unknown or other
  misc_feature (400)..(400): n is a, c, g, or t
tcagacatacgcgtcacgaccggtgctcgatttagctgcgtcacgatctctcttgggtttggggtccctgacactctcctgtgcagcctctggattcacagtcagcagcaatgccatgagttgggtccgccaggctccagggaagggttgcagtgggtctgggattggaagtgatggtgccanacactacgcagactccgtgagggccnttcatcatctccagagacgattccgaaaancagtgaatctgcaaatgtacaagccncagcgccgaggacacggccgtcactcngtgcgaaaagactctatttttggcgtcggccgactacgtgggcagggcacctggtcacgtctcttcagcctcacaaagcccaatccgtctcccctgccgccctgcccnccgacgacgccacctccgacgacgacacgacgccgccgtcggcgtcgccgtcgacgaacgtacgtactaccacgtacgtacgtcgtcgtcgacggcggcgacgacgacgacgacgacgag

SEQ ID NO: 356792 - DNA, 544 bp, Homo sapiens
  misc_feature: GZ8MTXP02F1BZ3.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggaccaaaccccccaactcatcatttatggtgtcactcgtcggccctcaggagtctcctcatcgcttctcaggcctccaagtctcggctaacaccggccctaccctaaccatcctctgggcctccagtttgaggacagtctacttattactgctagtttacctttaaattacgcgtccacttcgtcgttggtttcggcggtacggcgaccgagtcgaccgtcctacgtcacgtccgaacggctcgccccgtcggtcactttccg

SEQ ID NO: 356793 - DNA, 514 bp, Homo sapiens
  misc_feature: GZ8MTXP02JJX82.22.36.D03.1.454.CMB.2.raw
  modified_base (434)..(434): a, c, t, g, unknown or other
  misc_feature (434)..(434): n is a, c, g, or t
  modified_base (477)..(477): a, c, t, g, unknown or other
  misc_feature (477)..(477): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctctggtaccaacaacaccagcaaaccccccaatcatcatttatggtgtcactcgtcgccctcaggagtctcctcatcgcttctcagctcaagtctgcaacacgcctcccacatctctggctccagtttgagtacgagtctacttattactgtactagttcctttaaaattaggcncctacgtctcgtggtttcgcggtagcacggaacgtgaccgtcncggtcaggcccaaggctcgccccctcggtcacgtccg

SEQ ID NO: 356794 - DNA, 534 bp, Homo sapiens
  misc_feature: GZ8MTXP02HLNJ0.22.36.D03.1.454.CMB.2.raw
  modified_base (303)..(303): a, c, t, g, unknown or other
  misc_feature (303)..(303): n is a, c, g, or t
  modified_base (340)..(340): a, c, t, g, unknown or other
  misc_feature (340)..(340): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctctggtaccaacacaccagccaaaccccccatcatcattatgtntcactcgtcggccctcaggagtctcctcatcgcttcncagcctccaagtctgcaacacgccctccctaacactctctgggctccgagtttgaggtacgagtcttattattactgtctagttaccctttaaaatggccgtacacgttctcgttcggtttcggcggtacggcgaccgaaagtcgaaccgtccgtcggtcacgcccgaggcctcgccccctcggtccacttccg

SEQ ID NO: 356795 - DNA, 571 bp, Homo sapiens
  misc_feature: GZ8MTXP02HGO89.22.36.D03.1.454.CMB.2.raw
  modified_base (216)..(216): a, c, t, g, unknown or other
  misc_feature (216)..(216): n is a, c, g, or t
  modified_base (329)..(329): a, c, t, g, unknown or other
  misc_feature (329)..(329): n is a, c, g, or t
tcagacatacgcgtcacgaccggtgctcgatttagctgcgtcacgatctctcttgggggggtctcaggaggcagcactctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtctttgactctgtctcctggtaccaacaacacccagccaaaccccccatcactcatttatgtgtcactcgtcggcctcagagtctcnccatcgcttctcagctcagtctgcacacgcctccctacatctcgtggctccgagtttgagacgtagtctacttatactgctagttacctttaaagttcgactccacttcgttcggttcgggttttccggcgggtaacgggtcctaaaccggtaaggttccggacccgttccgtaccggggtaccacggaccccgtaaaggtccctccggcccccgttcggtaccctaccgtcctttccccgg

SEQ ID NO: 356796 - DNA, 567 bp, Homo sapiens
  misc_feature: GZ8MTXP02GU3DZ.22.36.D03.1.454.CMB.2.raw
tcagacatacgcgtcacgaccggtgctcgatttagctgcgtcacgatctctcgttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactagttgggtcttttgactctgtctcctggtaccaacaacaccagcaaacccccactcatcattatgtgtcactcgtcggccctcagagtctctcatcgaaacttctcagctcaactctgcaacacggcctcccaaccatctctgggctctagtttgagacgagtctacttattactgtctaagtttacctttaaagttaggtccgtaccacttctcggttcggttttcgggcggttacggccgtaccggtaagtacggaccgttccgtcggttaccgacgacccgaaaggtcctccggcccccgtccggtccaccgttcgtttcccccgg

SEQ ID NO: 356797 - DNA, 592 bp, Homo sapiens
  misc_feature: GZ8MTXP02IGQTT.22.36.D03.1.454.CMB.2.raw
  modified_base (218)..(218): a, c, t, g, unknown or other
  misc_feature (218)..(218): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtctttgactctgtctcctggtaccaacaacaccagccaaacccccatcatcattangtntcactcgtcgccctcaggatctcctcatcgcttctcacggcctccgaagtcctcggaccaacgaccgtccctaccctaaaccactcctcgtcggggccttaccgtagtttgaacggacgtagttaccttaactttatttacctgtactaacgtttaccctttaaaagttcggccgtacctacgttcgttcggttgggttttcggcggtacggccgtaccggacgtcgtacccgtccgtcggtacacggcccgaacggcctaccgcccccgttcggtacctaccgtcccg

SEQ ID NO: 356798 - DNA, 534 bp, Homo sapiens
  misc_feature: GZ8MTXP02I1EHK.22.36.D03.1.454.CMB.2.raw
  modified_base (301)..(301): a, c, t, g, unknown or other
  misc_feature (301)..(301): n is a, c, g, or t
  modified_base (358)..(358): a, c, t, g, unknown or other
  misc_feature (358)..(358): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctggtaccaacaacacccagccaaaccccccactcatcatttangtgtcactcgtcgcctcagagtctctcatcgcttctcaggctccaagtctggcaacncgcctcccaacatctctggctccagttgagacgagtctacttatactgctagtttaccttaaagtagccgacctacttcgtcgttggtttccggcggtacggtcaccgtaaaggtcgtaccgtccgtcggtcacgtcccaaggcctccgcccccgtcggcctaccgtctttccccg

SEQ ID NO: 356799 - DNA, 636 bp, Homo sapiens
  misc_feature: GZ8MTXP02HGXQC.22.36.D03.1.454.CMB.2.raw
  modified_base (323)..(323): a, c, t, g, unknown or other
  misc_feature (323)..(323): n is a, c, g, or t
  modified_base (402)..(402): a, c, t, g, unknown or other
  misc_feature (402)..(402): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatgccatgagttgggccgccaggctccgaggggaggggttncgaggtgggtcgtcggggattggggaagtgagtgggtcgccaacacactaacgcagaccgtccggtagacgggggcccncttccgactcgactcctccgagacgacgaacttacccgaaaacacgagtagaaatcgtagactaaagtcgtaacacgacctcgacggccgaccggacggaccgaccgggtcccgtaccgttaccgttcgtcgtacggaccggtaaaacggtacccttacgtttaacggtttttccgggcccggtcccgggacccggtaaccgttaccggtaccgggggacccgtaacccggggg

SEQ ID NO: 356800 - DNA, 558 bp, Homo sapiens
  misc_feature: GZ8MTXP02GIAPW.22.36.D03.1.454.CMB.2.raw
  modified_base (309)..(309): a, c, t, g, unknown or other
  misc_feature (309)..(309): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctggacactctcctgtgcagcctctggattcacagtcagcagcaatgccatgagttggccnccaggctccgaggggaaggggttgcgaggtggggtctcggggattgggaagtgagtggtcgccacacactacgcacgacgtccggtggacgggggccgtcgttcactcactcctccagagacgataccgaaaacacagtagtaatttgacaaatgtacagcctacgagcgaccgaggaccgacggccgtctacttctgtcgacgaaacgtaacctcgttagttttcgggcgtccggaccgtacgtacgg

SEQ ID NO: 356801 - DNA, 545 bp, Homo sapiens
  misc_feature: GZ8MTXP02GAZSD.22.36.D03.1.454.CMB.2.raw
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
  modified_base (394)..(394): a, c, t, g, unknown or other
  misc_feature (394)..(394): n is a, c, g, or t
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
  modified_base (421)..(421): a, c, t, g, unknown or other
  misc_feature (421)..(421): n is a, c, g, or t
  modified_base (448)..(448): a, c, t, g, unknown or other
  misc_feature (448)..(448): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccggggggtccctgacactctcctgtgcagcctctggattcacagtcagcagcaatgccatgagttggtccgccaggctccgaggggaggggttgcgagtgggtctcggggattgggaagtgatgggtnccancactacgcagactccgtgacggggccnctnatcatcncagagacatcgaaaacncagtagatctgacaaatgtacagcctnacgcgaccgaggaccgacggccgtactaccttcgtacgtacgacgaaaagtcccgttacgttacgttttcggggaccgtccgggtacccgtaaccgg

SEQ ID NO: 356802 - DNA, 699 bp, Homo sapiens
  misc_feature: GZ8MTXP02FOL8D.22.36.D03.1.454.CMB.2.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactcttgtctctgtaaccaacaaccaccgacgacccaaacccccaactcactactatttagtggtcgtacactcgtccggtccctacgaggtactcctccctactacgtcgtctttctacgacggtcctaccgtaaacgttcgtacggaccaaacgaccggtaccccttaccctaaacctacttcctccgtcgggtcccttaccgtaggtttacggaacgggtacgtacgttacctttaaactttacttaacgtcgtacttaacgttttaacctttaaaagttacgggcctacctactttccgttcggtttcggggttttccgggacgggtacggaccgtaaacccggtaaggttaccgtacccggttcccgttacgggtccaaaccgaaccccggaaacggtcccgttacccggtccccccgttacgggtaccctacctttccccgg

SEQ ID NO: 356803 - DNA, 545 bp, Homo sapiens
  misc_feature: GZ8MTXP02F8T9P.22.36.D03.1.454.CMB.2.raw
  modified_base (307)..(307): a, c, t, g, unknown or other
  misc_feature (307)..(307): n is a, c, g, or t
  modified_base (368)..(368): a, c, t, g, unknown or other
  misc_feature (368)..(368): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttggtccncaggctcgaggggagggttgcaggtgggtcgtcggggatttgggaagtgagtggtcgaccncacacgtacgcagactccggtggaggggccgcgttcatcatctccagagacgacttaccgaaaacacgagtagatctagacaaatgtacacgcctcagcgacgacggacacggccgtactaccttcgtacgtgacgaacgtacctacgttacgttttcggccggtcggccgtaaccg

SEQ ID NO: 356804 - DNA, 556 bp, Homo sapiens
  misc_feature: GZ8MTXP02HTK5Z.22.36.D03.1.454.CMB.2.raw
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccatgacactctcctgtgcagcctctggattcacagtcagcagcaatgccatgagttgggtccgccaggctccgaggggaaggggttgcgaggtgggtcgtcggggattggaagtgagtgggtnccanaccactcggcagactccgtgggacgggggcctctcatcatctccagagacgataccgaaaacacagtagaatactagacaaatgtacacgcctacagccgacgacgacaccggctctacttccgtgtacgacgaacgtaccgttacttaacgttttcgggccgtcggcccgtacgtacggtcggggcccgg

SEQ ID NO: 356805 - DNA, 517 bp, Homo sapiens
  misc_feature: GZ8MTXP02GL9AU.22.36.D03.1.454.CMB.2.raw
  modified_base (440)..(440): a, c, t, g, unknown or other
  misc_feature (440)..(440): n is a, c, g, or t
tcagacatacgcgtcacgaccggtgctcgatttagctgcgtcacgatctctcttggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcattcctgcactgggaccaacagtgacattgggtcttttgactctgtctcctggtaccaacacacccaggcaaaccccccatcatcacttatgtgtcactcgtcggcctcagagtctctccatcgcttctcaggctccaagtctggctaacatcgcctaccctaacatctctgggctccagtttgaggacgtagtctattacttactgtctagtttcctttaaaattacggcncctactctcgtggttttcggcgtacggcaccgaagtcgaccgtctcggtcacgccgaggctcgcccctcggcacgtc

SEQ ID NO: 356806 - DNA, 542 bp, Homo sapiens
  misc_feature: GZ8MTXP02HD7QF.22.36.D03.1.454.CMB.2.raw
  modified_base (217)..(217): a, c, t, g, unknown or other
  misc_feature (217)..(217): n is a, c, g, or t
  modified_base (248)..(248): a, c, t, g, unknown or other
  misc_feature (248)..(248): n is a, c, g, or t
  modified_base (537)..(537): a, c, t, g, unknown or other
  misc_feature (537)..(537): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattccgaaaancagtgaatctgcaaatgtacagcctcagcgccgaggacacggccgtctactctgtgcgaaagacctctattttgggccgcggccgacctacgtcggggccagggcacccgtggtccaccgtctcttcacgcctccaccaagggcccagtccggtcttccccctggccgcccctgcctccgaggacgccacctcccgagacgcacgagccggccctggggctcggccctgggtcaaacgggtcctacttccacgccggtaatcgtcctggacgcggctcggcaagggtcncaatg

SEQ ID NO: 356807 - DNA, 540 bp, Homo sapiens
  misc_feature: GZ8MTXP02JFV3I.22.36.D03.1.454.CMB.2.raw
  modified_base (248)..(248): a, c, t, g, unknown or other
  misc_feature (248)..(248): n is a, c, g, or t
  modified_base (414)..(414): a, c, t, g, unknown or other
  misc_feature (414)..(414): n is a, c, g, or t
  modified_base (534)..(534): a, c, t, g, unknown or other
  misc_feature (534)..(534): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacncagtgaatctgcaaatgtacagcctcagcgccgaggacacggccgtctactctgtgcgaaagacctctatttttgggccgcggccgacctactggggccagggcaacctggtcaccgtctcttcagcctccaccaacgggcccatccggtccttcccccgtggccncccctgcctccacggacgccaccctccgacgacgcacgacgccggccctgggctcgcctgggtcaacggtactaccttccgacggtcgtactcgtcctgacgcgggctcgggcaagggcncgatag

SEQ ID NO: 356808 - DNA, 640 bp, Homo sapiens
  misc_feature: GZ8MTXP02JVGJN.22.36.D03.1.454.CMB.2.raw
  modified_base (394)..(394): a, c, t, g, unknown or other
  misc_feature (394)..(394): n is a, c, g, or t
  modified_base (441)..(441): a, c, t, g, unknown or other
  misc_feature (441)..(441): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacgaggccggggggtccctgacactctcctgtgcagcctctggattcacagtcagcagcaatgccatgagttgggccgcaggctccgaggggagggttgcgaggtgggtcgtcggggattggaagtgagtggtcgccacacacgtacgcagactccggtggacgggccncttacatcgactccgtaccgagtaacgacgtacttaacccgaaaacncgagtacgaaatcctagactaaagtcgtaacacgtcctacgacgccggaccgaggacccgaccggcccgttactaccgttcgtacggtacgaaccggtaaaacgttacccgtttacggtttaacggttttcccgggggaccccgtaccggggtaccccgtaaccggttaaccgggttccgggggacccgtaaccggggg

SEQ ID NO: 356809 - DNA, 512 bp, Homo sapiens
  misc_feature: GZ8MTXP02IWR6H.22.36.D03.1.454.CMB.2.raw
  modified_base (326)..(326): a, c, t, g, unknown or other
  misc_feature (326)..(326): n is a, c, g, or t
  modified_base (370)..(370): a, c, t, g, unknown or other
  misc_feature (370)..(370): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacaccaggccaaaccccccaatcatcatttatggtgtcactcgtcggcccctnaggagtctcctcatcgcttctcaggctccaagtctggccaaacncggcctcccgtaacatctctgggctccagtttgaggtacgagtctacttattactgctagttcttaaatcgcgctactctcgtgtttcgcggtagcacgagtcgacgtctcgtcagtccgaagctcgcccctggtcacttcg

SEQ ID NO: 356810 - DNA, 540 bp, Homo sapiens
  misc_feature: GZ8MTXP02IUQXI.22.36.D03.1.454.CMB.2.raw
  modified_base (307)..(307): a, c, t, g, unknown or other
  misc_feature (307)..(307): n is a, c, g, or t
  modified_base (322)..(322): a, c, t, g, unknown or other
  misc_feature (322)..(322): n is a, c, g, or t
  modified_base (341)..(341): a, c, t, g, unknown or other
  misc_feature (341)..(341): n is a, c, g, or t
  modified_base (352)..(352): a, c, t, g, unknown or other
  misc_feature (352)..(352): n is a, c, g, or t
  modified_base (373)..(373): a, c, t, g, unknown or other
  misc_feature (373)..(373): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggacccaacagtgactattggtctttgactctgtctctgtaccaacaacacccagacccaaacccccactcatcatttatgtntcactcgtcgccctnaggatctctcatcgcttcncagctcagtcngcacacgcctcctacatctcnggctcgtagttgaggacagtctacttattactcgtctacgtttacctttaaatacggcctacctactcgttcgttggttttcggcgggtacggcgaccggtaagtcgacccggttcctccggtactacgcccgaaggtcctccggcccccgtcggtccactttcccg

SEQ ID NO: 356811 - DNA, 617 bp, Homo sapiens
  misc_feature: GZ8MTXP02HPQST.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcttgggtacaggccggggggtccctgacactctcctgtgcagcctctggattcacagtcagcagcaatgccagtgaggtttgggccgccgaggcctccgaggggtaaggggttgcgtaggtggggtcgtcggggattgggaagtgagtggtgcccacacactacgcaagacctccggtgacgggggccacttcatcatcctccagagacgacttaccgaaaacacgaagtagaaactctagactaaatcgtaacacgcctacgacgccgaccggaacggaccgacggtcccgtacgttacctttcgtacggttacgacgtaaacgtaccgttacgttaacgtttttcggggacccggtcggtacccggacgttaccggtcgggggtaccgacccgggg

SEQ ID NO: 356812 - DNA, 506 bp, Homo sapiens
  misc_feature: GZ8MTXP02G90GY.22.36.D03.1.454.CMB.2.raw
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
  modified_base (405)..(405): a, c, t, g, unknown or other
  misc_feature (405)..(405): n is a, c, g, or t
  modified_base (418)..(418): a, c, t, g, unknown or other
  misc_feature (418)..(418): n is a, c, g, or t
  modified_base (504)..(504): a, c, t, g, unknown or other
  misc_feature (504)..(504): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattccgaaaacncagtgaatctgcaaatgtacagcctcagcgccgaggacacggccgtccacttctgtgcgaaagacctctatttttgggccgcggccgacctactggggccagggcaccctggtcaccgtctcttcagcctccaccaaggcccatcgtctcccctgcnccctgctccagcncacctccgagagcacagccggcctgggctgcctggtcaaggactacttccacgcgtactcgtctgagccggctcggcaaggcgcanag

SEQ ID NO: 356813 - DNA, 515 bp, Homo sapiens
  misc_feature: GZ8MTXP02J0DMA.22.36.D03.1.454.CMB.2.raw
  modified_base (417)..(417): a, c, t, g, unknown or other
  misc_feature (417)..(417): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctactctgtgcgaaagacctctatttttgggccgcggccgacctactggggccagggcaccctggtcaccgtctctcagcctcaccaggcccatcgtctcccctgcgccctgctccaggacncaccctccgagacgcacgagccggccctggggcctgcctggtcaaggtacctactccacgtccgtatcgtctggacgcgggctggcaaggcgacatag

SEQ ID NO: 356814 - DNA, 592 bp, Homo sapiens
  misc_feature: GZ8MTXP02F8THO.22.36.D03.1.454.CMB.2.raw
  modified_base (214)..(214): a, c, t, g, unknown or other
  misc_feature (214)..(214): n is a, c, g, or t
  modified_base (246)..(246): a, c, t, g, unknown or other
  misc_feature (246)..(246): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaagggttgcagtgggtctcggggattggaagtgatggtgccacacactacgcagactccgtgagggccncttcatcatctccagagacgattccgaaaacncagtgaatctgcaaatgtacagcctcagcgccgaggacacggccgtctactctgtgcgaaagacctcttatttttgggccgcggccgacctactggggccagggcacccgtggtccaccgtctcttcacgcctccaccgaacgggcccatccggtccttcccccgtggcccgccccttgccttcccgaggacgccaccctccgacgacgccacgacgcccggcccgtggggcctcggcctcgggtaccaacgggtaccttaaccgttcccgaaccggtcgttaacgtcggtaaccgtcggaacggccgggggtccttcggggaccaacggggccggacaacgtcgg

SEQ ID NO: 356815 - DNA, 591 bp, Homo sapiens
  misc_feature: GZ8MTXP02JXPFE.22.36.D03.1.454.CMB.2.raw
  modified_base (369)..(369): a, c, t, g, unknown or other
  misc_feature (369)..(369): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggaccaaaccccccactcatcatttatggtgtcactcgtcggccctcaggagtctcctcatcgcttctcaggctccaagtctggcaacnccgccctaccctaaccatctcgtgggcctcctagtttgacggtacgagtctacttattactgtactagtttacctttaaaagtcggtaccgtacctacgttcgttcggttcgggttttacggcgggtacggtccgaccggtaaacgtcggaaccgttccgtccggttccgacggccccgaaacggtccgtccggtcccccgtccgggtacctaccgttcccg

SEQ ID NO: 356816 - DNA, 623 bp, Homo sapiens
  misc_feature: GZ8MTXP02IJKHJ.22.36.D03.1.454.CMB.2.raw
  modified_base (403)..(403): a, c, t, g, unknown or other
  misc_feature (403)..(403): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacgaggccgggggggttcctgacactctcctgtgcagcctctggattcacagtcagcagcaatgccatgagttgggccgccgaggctccgaggggaggggttgcgaggtgggtcgtggggattgggaaagtgagtgggtgccacacactacgcagaccgtcccggtggacgggggccncttacatcatctccagacgacgacttaccgaaaacacgagtagaaactctagaactaaatacgtaacacgcctacgacgccgaccggaacggaccgaaccggcccgttacgttaccttcgtacgtacggacgtaaaacgtaccctttacgtttaacggtttttcggggcccgtaccgggtacccggtaacgttaccggtcgggggtaacccgaccggggg

SEQ ID NO: 356817 - DNA, 626 bp, Homo sapiens
  misc_feature: GZ8MTXP02J3UER.22.36.D03.1.454.CMB.2.raw
  modified_base (391)..(391): a, c, t, g, unknown or other
  misc_feature (391)..(391): n is a, c, g, or t
  modified_base (408)..(408): a, c, t, g, unknown or other
  misc_feature (408)..(408): n is a, c, g, or t
  modified_base (427)..(427): a, c, t, g, unknown or other
  misc_feature (427)..(427): n is a, c, g, or t
  modified_base (435)..(435): a, c, t, g, unknown or other
  misc_feature (435)..(435): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacgaggccgggggggtccctgacactctcctgtgcagcctctggattcacagtcagcagcaatgccatgagttgggtccgccgagctccgaggggagggttgcagtgggtctcggggattggaagtgacctggtgccacacacctacgcagactccgtgacggggccnttcatccatctccaganacggattaccccgaaaaanacgagtanatcagactaagtcgtaaccgacgccctaccgacggaccggaccgggacggaccgaacccggtacccgttaccttaccgttaccgttacggtacgtaaccgtaaaccgtacccgttaccgtttacggttttaaccggggtacccggtacccggtacccggtacccgtaccggtaccggggaccggtaccggg

SEQ ID NO: 356818 - DNA, 589 bp, Homo sapiens
  misc_feature: GZ8MTXP02JLA1J.22.36.D03.1.454.CMB.2.raw
  modified_base (302)..(302): a, c, t, g, unknown or other
  misc_feature (302)..(302): n is a, c, g, or t
  modified_base (363)..(363): a, c, t, g, unknown or other
  misc_feature (363)..(363): n is a, c, g, or t
  modified_base (400)..(400): a, c, t, g, unknown or other
  misc_feature (400)..(400): n is a, c, g, or t
  modified_base (476)..(476): a, c, t, g, unknown or other
  misc_feature (476)..(476): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccggggggtccctgacactctcctgtgcagcctctggattcacagtcagcagcaatgccatgagttgggccnccaggctccgaggggagggttgcgtaggtgggtcgtcggggattgggaaagtgagtgggtnccacacactacgcagaccgtccggtgacgggggcccncttcgatcactcctaccagacgacgacttaaccgaaaacacagtacgaaatcgtagacaaatagtaacacgtaccncgaacgccgaccggaacggaccgaccggcccgtcgtacttcgtcgtcgacgaaacgtaccttacttagttttcggccgaccggtaccgtacgtaccgtcggggaccgaccggg

SEQ ID NO: 356819 - DNA, 520 bp, Homo sapiens
  misc_feature: GZ8MTXP02GJC2O.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaactcatcatttatggcgtcactcgtcggccctcaggacgtctcctcatcgcttctcagctccaagtctgcaacgacgcctaccctaacactctctgggctccagtttgaggacgagtctacttatactgctagttacctttaaatcgcgctactctgtgtttcggcggtacgcacgagtcgaccgtcgtcggtcacgccgaacgctcgcccctcggtccactcccg

SEQ ID NO: 356820 - DNA, 582 bp, Homo sapiens
  misc_feature: GZ8MTXP02IBEZB.22.36.D03.1.454.CMB.2.raw
  modified_base (216)..(216): a, c, t, g, unknown or other
  misc_feature (216)..(216): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggtaccaacaacacccaggcaaacccccccaactcatcatttatggtgtcactcgtcggcctcaggagtctctccatcgcttctcaggctccaagtctggcaacaccggcctcccaaacccatctctgggcctcctagtttgaggacgagtctacttattactgctagtttacctttaaagttacggtcgcctaacttcctcggtttcggttttccgggtacgggtacggtccaccggtaggtacgtacccggtccgtccggttacacggcccgaaacggtcctaccggcccccgtccggtccctaccgttccgtttcccg

SEQ ID NO: 356821 - DNA, 533 bp, Homo sapiens
  misc_feature: GZ8MTXP02F599K.22.36.D03.1.454.CMB.2.raw
  modified_base (363)..(363): a, c, t, g, unknown or other
  misc_feature (363)..(363): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctctggtaccaacaacacccagccaaacccccatcatcatttatggtgtcactcgtcggccctcaggagtctcctcatcgcttctcaggctccaagtctgcaacncgcctccctaacatctctggcctccagtttgaggacgtagtctacttattactgtctagtttacctttaaaattcggcgtacctacttcgttcgttgggttttcggcggtacggcaccggagtcgaccgtccgtcggtcagcccgaagctcgcccctcggtccacttccg

SEQ ID NO: 356822 - DNA, 525 bp, Homo sapiens
  misc_feature: GZ8MTXP02IBSOL.22.36.D03.1.454.CMB.2.raw
  modified_base (247)..(247): a, c, t, g, unknown or other
  misc_feature (247)..(247): n is a, c, g, or t
  modified_base (410)..(410): a, c, t, g, unknown or other
  misc_feature (410)..(410): n is a, c, g, or t
  modified_base (430)..(430): a, c, t, g, unknown or other
  misc_feature (430)..(430): n is a, c, g, or t
  modified_base (521)..(521): a, c, t, g, unknown or other
  misc_feature (521)..(521): n is a, c, g, or t
  modified_base (524)..(524): a, c, t, g, unknown or other
  misc_feature (524)..(524): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaagggttgcagtgggtctcggggattggaagtgatggtgccacacactacgcagactccgtgaggggccgcttcatcatctccagagacgattccgaaaacncagtgaatctgcaaatgtacagcctcagcgccgaggacacggccgtctacttctgtgcgaaagacctctattttcgggccgcggccgactacgtggggccagggcacccgtgtccaccgtctcttcacgcctccaccacgggcccatccggtccttcccccgngccgccctgcctccgaggcnccaccctccgagagcacgacgccggccctgggctggcctggtcaaggctacttccacgcgtatcgtcgtgacggtcggctggacaggccgnagng

SEQ ID NO: 356823 - DNA, 584 bp, Homo sapiens
  misc_feature: GZ8MTXP02G2WLB.22.36.D03.1.454.CMB.2.raw
  modified_base (327)..(327): a, c, t, g, unknown or other
  misc_feature (327)..(327): n is a, c, g, or t
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacagccgggggggtccctgacactctcctgtgcagcctctggattcacagtcagcagcaatgccatgagttgggtccgccaggctccgaggggaaggggttncgagtgggtctcgggggattgggaagtgagtggtgccacacactacgcagactccgngacgggggccncttcgatcatctaccgagacgacgacttaccgaaaacaccagtagaaactctagacaaatacgtacacgcctcagccgaccgaggacgtaccggcccgttactacctttccgtgtacgtacgaaaacgtacccttacttacgttttcgggccgtccgggcccgtacgttacggcggggacgaaccgggg

SEQ ID NO: 356824 - DNA, 635 bp, Homo sapiens
  misc_feature: GZ8MTXP02F7Q3J.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcttgggtacgaggccggggggtccctgacactctcctgtgcagcctctggattcacagtcagcagcaatgccatgagttgggtcccgccgaggcctccgaggggaaggggttgcgagggtgggtcgtcggggatggaagtgagtggtgaccacacactacgcaagaccgtccggtggacgggggcccgcttcgactcactcctaccgagacgacgacttaacccgaaaactacgaagtacgaaatctagactaaagtcgtacacgcctacgacggccgaccggaggaccgaccggtcccggttacttaccgttcgtacggtacggaaccggtaaaacgtacccgttacgtttacggttttccggggcccgtccgggtacccgtaccgttaccggtcgggggacccgtaaccggggg

SEQ ID NO: 356825 - DNA, 545 bp, Homo sapiens
  misc_feature: GZ8MTXP02F5M9O.22.36.D03.1.454.CMB.2.raw
  modified_base (321)..(321): a, c, t, g, unknown or other
  misc_feature (321)..(321): n is a, c, g, or t
  modified_base (358)..(358): a, c, t, g, unknown or other
  misc_feature (358)..(358): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccgggggggtccatgacactctcctgtgcagcctctggattcacagtcagcagcaatgccatgagttggccgcaggctccgagggaggggttncgaggtgggtctggggattgggaagtgatggtgccanacactcgcagactccgtgacggggccgctcatcatctcagagacgacttaccgaaaacacagtagaatactagacaaatagtacacgcctacgacgcgccgagacgacggtccgtctacttcgtcgtcgacgaaacgaccttcgttaacgttttcggccgtccggccgacgtacgtcggggacccgg

SEQ ID NO: 356826 - DNA, 577 bp, Homo sapiens
  misc_feature: GZ8MTXP02FWI4R.22.36.D03.1.454.CMB.2.raw
  modified_base (364)..(364): a, c, t, g, unknown or other
  misc_feature (364)..(364): n is a, c, g, or t
  modified_base (399)..(399): a, c, t, g, unknown or other
  misc_feature (399)..(399): n is a, c, g, or t
  modified_base (469)..(469): a, c, t, g, unknown or other
  misc_feature (469)..(469): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccgggggggttcctgacactctcctgtgcagcctctggattcacagtcagcagcaatgccatgagttgggtccgcaggctccgaggggaaggggttgcaggtggggtcgtcggggattgggaagtggagtgggtnccgacacactacgcagactccggtgacgggggccncttcatcactctaccagacgacgacttaccgaaaactacagtagaaatctagacaaatgtaacagtcccncaacgccgaccgaggaccacggccgttactacgttctgtacgacgaaacgtaccgttcttacgttttcgggcccgtccggaccggacgtacgtcggggaccaccgggg

SEQ ID NO: 356827 - DNA, 546 bp, Homo sapiens
  misc_feature: GZ8MTXP02H3VQD.22.36.D03.1.454.CMB.2.raw
  modified_base (545)..(545): a, c, t, g, unknown or other
  misc_feature (545)..(545): n is a, c, g, or t
tcagacatacgcgtcacgaccggtgctcgatttagctgcgtcacgatctctcttgggttttgggggtccctgacactctcctgtgcagcctctggattcacagtcagcagcaatgccatgagttggtccgccaggctccagggaagggttgcagtgggtctcggggattggaagtgatggtgccacacactacgcagactccgtgagggccgcttcatcatctccagagacgattaccgaaaacacagtgaatctgacaaatgtacagcctcagcgccgaggacacggccgtctacttctgtgcgaaagaccttctagtttttcgggccgcggccgacctacgtcggggccagggcacccgtcggtcaccgtctccttcacgcctccacccaacgggcccacgtcggtccttcccccgtggcccgtcccctcgacctcccgaggacgccaccgtccgagacgcacgacgcgccctgggcctgcctgtcaacggctacgttccacgtcgtatcgcctgacggcggctaggccaaggccgacgacgng

SEQ ID NO: 356828 - DNA, 548 bp, Homo sapiens
  misc_feature: GZ8MTXP02GVSXQ.22.36.D03.1.454.CMB.2.raw
  modified_base (302)..(302): a, c, t, g, unknown or other
  misc_feature (302)..(302): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (391)..(391): a, c, t, g, unknown or other
  misc_feature (391)..(391): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccggggggtccctgacactctcctgtgcagcctctggattcacagtcagcagcaatgccatgagttgggtcccncaggctccgaggggaaggggttgcaggtgggtctcggggattggaagtgatgggtnccanacactacgcagactccgtgacgggggccncttcatcatctccagagacgacttaccgaaaacacagtcgaaatctagacaaatgtacagcctcacgcgaccgaggacacggccgtactaccttctcgtcgacgaacgacctctacgttttcgggccgtcggccgacgtacgtcggggaccgacggg

SEQ ID NO: 356829 - DNA, 537 bp, Homo sapiens
  misc_feature: GZ8MTXP02GPJL3.22.36.D03.1.454.CMB.2.raw
  modified_base (304)..(304): a, c, t, g, unknown or other
  misc_feature (304)..(304): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccggggggtccctgacactctcctgtgcagcctctggattcacagtcagcagcaatgccatgagtggccnccaggctccgaggggaggggttgcagtgggtctcggggattggaagtgatggtgccacacactacgcagactccgtggacgggccgctcatcactctccagacgacgacttaccgaaaacacaagtagaaatctagacaaatgtaacagcctcagccgaccgacggaccgaccggccgtctacttcctgtgacgaaagaccctcttacgttttcggccgtccggccgtaaccg

SEQ ID NO: 356830 - DNA, 628 bp, Homo sapiens
  misc_feature: GZ8MTXP02GYGKO.22.36.D03.1.454.CMB.2.raw
  modified_base (309)..(309): a, c, t, g, unknown or other
  misc_feature (309)..(309): n is a, c, g, or t
  modified_base (324)..(324): a, c, t, g, unknown or other
  misc_feature (324)..(324): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccagaccaaaccccccactcatcatttatggtntcactcgtcgccctnaggagtctcctcatcgcttctcagcctccaagtctgaccaacgaccggccctaccctaaccactcctcgtcggggccttacccgtaggtttcggaacgggtaccgtacgttccttaaactttatttaccgtgtactacgttttacctttaaaagttcggtaccgtacctacttcgttcggtttcgggttttcgggaccggtacggtccgaaccggtaaacggtccggaacccgttccgtaccgggttccacggaaccccgtaacggcccttcccggcccccgttcggtccctaccgtttccccg

SEQ ID NO: 356831 - DNA, 552 bp, Homo sapiens
  misc_feature: GZ8MTXP02H1V1O.22.36.D03.1.454.CMB.2.raw
  modified_base (426)..(426): a, c, t, g, unknown or other
  misc_feature (426)..(426): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtctttgactctgtctctgtaccaacacaccagaccaacccccatcatctattatgtgtcactcgtcgcctcgagacgtctctccatccgtcttctcacggtcctcgaagtctacggccaaacgccgccctaccctaaccactctcgtcgggcctctagtttgagacgtagtctacttattctncttattctttaaagtcgcgtacctacttctcggttcggtttcgcggtacggtcacggtaacgtcgtaccgtccgtcggtccacggcccgaacggcctccgtcccccgtcggtccacgttcctcccg

SEQ ID NO: 356832 - DNA, 611 bp, Homo sapiens
  misc_feature: GZ8MTXP02FQYFP.22.36.D03.1.454.CMB.2.raw
  modified_base (265)..(265): a, c, t, g, unknown or other
  misc_feature (265)..(265): n is a, c, g, or t
  modified_base (319)..(319): a, c, t, g, unknown or other
  misc_feature (319)..(319): n is a, c, g, or t
tcagacatacgcgtcacgaccggtgctcgatttagctgcgtcacgatctctcttgggtttgggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcgactccacgagacgactacgtaaacaaacagtaggaatactcgngaaactaagtacaagacctctagacgccgacggacgacgcggtcctactctcgngtcgaagaactcctagttttggtccggcgccggactaccgtgggccgacggcgacctcgtcgccgcctcttctacgcctccaccaacggccgactcggttccgtcccctccgtgcccctcgtctcccacggaacgcgacctccccgagagcgaccaacggcggcccccgtggggcgtcgtcccggtggttacgaacgggaaacttaacctttccgtaaccggccgtaacgttgtccgtttacgaaggtccgggggcttcgggtacgaaacgggcggaccgaacgtacgtacg

SEQ ID NO: 356833 - DNA, 531 bp, Homo sapiens
  misc_feature: GZ8MTXP02F5I6X.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccggggggtccctgacactctcctgtgcagcctctggattcacagtcagcagcaatgccatgagttggccgccaggctccgaggggaggggttgcagtgggtctcggggattggaagtgatggtgccacgcactacgcagactccgtgagggccgcttcatcatctccagacgacgacttaccgaaaacacagtagaatctagacaaatgtacagctcagcgacgacggacgacggccgtactacttctgtcgacgaaacgacctacgttacgttttcggccgtcggccgtaaccgg

SEQ ID NO: 356834 - DNA, 541 bp, Homo sapiens
  misc_feature: GZ8MTXP02J1NE5.22.36.D03.1.454.CMB.2.raw
  modified_base (393)..(393): a, c, t, g, unknown or other
  misc_feature (393)..(393): n is a, c, g, or t
  modified_base (481)..(481): a, c, t, g, unknown or other
  misc_feature (481)..(481): n is a, c, g, or t
  modified_base (499)..(499): a, c, t, g, unknown or other
  misc_feature (499)..(499): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttgggtacaggccgggggggtccctgacactctcctgtgcagcctctggattcacagtcagcagcaatgccatgagttgggtccgccaggctccaggggaaggggttgcagtggggtctcgggggattgggaagtgatgggtgccacacactacgcagactccgtgagggggccncttcatcatctccagagacgattaccgaaaacacagtgaaatctgacaatgtacagcctcagcgccgaggacacggccgtctacttcngtacgacgaaagaccctnttacgttttcgggccgcggccgacgtacgtcggggccacggg

SEQ ID NO: 356835 - DNA, 657 bp, Homo sapiens
  misc_feature: GZ8MTXP02G368Q.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttgggtacgaggccgggggggtccctggacactctcctgtgcagccctctggattcacagtcagcagcaatgccatgagttcgggtccgccaggctccgaggggaaggggttgcgaggtgggtcgtcggggattgggaagtgagtgggtcgccaacacactacgcaacgactccggtggacggggcccgcttcgatcatctccgagacgacgtactaccgaaaacacgagtacgaaatctagacaaaagtcgtaacacgccctacgaacggccgaccggaacggaaccgacccgggtacccggttaccttaaccgtttccgtcggttacggaaccggtaaaaacgtacccctttacgtttaacggtttttccggggccccggtaccggggtaccccggtaaccgttaacccggtcggggggaccccgtaaccggggg

SEQ ID NO: 356836 - DNA, 536 bp, Homo sapiens
  misc_feature: GZ8MTXP02JR5MT.22.36.D03.1.454.CMB.2.raw
  modified_base (365)..(365): a, c, t, g, unknown or other
  misc_feature (365)..(365): n is a, c, g, or t
  modified_base (390)..(390): a, c, t, g, unknown or other
  misc_feature (390)..(390): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccactcatcatttatgtgtcactcgtcggccctcaggagtctcctcatcgcttctcaggctcaagtctgcaacncgcctccctaaccatctctggctcngttgagacgagtctacttattactgctagtttaccttaaattacggcgtacctactcgttcgttgggttttcggcggtacggcgaccgaagtcgaccgtccgtcggtcacgcccgaacggcctacgccccctcggtccacttcccg

SEQ ID NO: 356837 - DNA, 519 bp, Homo sapiens
  misc_feature: GZ8MTXP02F0215.22.36.D03.1.454.CMB.2.raw
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
  modified_base (426)..(426): a, c, t, g, unknown or other
  misc_feature (426)..(426): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccncttcatcatctccagagacgattccgaaaacncagtgaatctgcaaatgtacagcctcagcgccgaggacacggccgtctacttctgtgcgaaagacctcttatttttgggccgcggccgacctacgtcggggccagggcacccgtggtccaccgtctcttcagcctccaccaaggcccatcgtctcccctgccgccctgcctccaggacnccacctccgagcgcacagccgcccgtgggctcgcctggtcaaggctacttccacgcgtatcgtctgacggcggctcggacaggccgacagtag

SEQ ID NO: 356838 - DNA, 506 bp, Homo sapiens
  misc_feature: GZ8MTXP02ILV04.22.36.D03.1.454.CMB.2.raw
  modified_base (230)..(230): a, c, t, g, unknown or other
  misc_feature (230)..(230): n is a, c, g, or t
  modified_base (318)..(318): a, c, t, g, unknown or other
  misc_feature (318)..(318): n is a, c, g, or t
tcagacatacgcgtcacgaccggtgctcgatttagctgcgtcacgatctctcttggggtgggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactggaccaanagtgacattgggtcttttgactctgtctcctggtaccacaacaccagccaaaccccccatcatcatttatgtgtcactcgtcgccctnaggatctctcatcgcttctcagctcaagtctgcacacgcctccacatctctggctcagtttgagacagtctacttattactgctagttacctttaaatacgcgcctactcttcgttggtttcggcggtacgtcaccgaagtcgacccgtctcggtcacggccaggctccgcccctcggtccacttccg

SEQ ID NO: 356839 - DNA, 492 bp, Homo sapiens
  misc_feature: GZ8MTXP02JHGI9.22.36.D03.1.454.CMB.2.raw
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
  modified_base (395)..(395): a, c, t, g, unknown or other
  misc_feature (395)..(395): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattccgaaaacncagtgaatctgcaaatgtacagcctcagcgccgaggacacggccgtctacttctgtgcgaaagacctctatttttgggccgcggcgacctactggggccagggcacctgtcacgtctctcagcctcacaggcccatcgctccctgcnccctgctccagcgcacctccgagacgcacgagccggccctgggctgcctggtcacggctactccacgcgtatcgtctgagcggctggcaggcgcatg

SEQ ID NO: 356840 - DNA, 522 bp, Homo sapiens
  misc_feature: GZ8MTXP02F7FGZ.22.36.D03.1.454.CMB.2.raw
  modified_base (216)..(216): a, c, t, g, unknown or other
  misc_feature (216)..(216): n is a, c, g, or t
  modified_base (365)..(365): a, c, t, g, unknown or other
  misc_feature (365)..(365): n is a, c, g, or t
  modified_base (440)..(440): a, c, t, g, unknown or other
  misc_feature (440)..(440): n is a, c, g, or t
  modified_base (460)..(460): a, c, t, g, unknown or other
  misc_feature (460)..(460): n is a, c, g, or t
  modified_base (496)..(496): a, c, t, g, unknown or other
  misc_feature (496)..(496): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggtaccaacaacacccaggccaaaccccccatcatcatttatgtgtcactcgtcggccctcaggagtctctccatccgcttctcaggctccaagtctggcaacncgcctccctaacatctctgggctccagttcgaggacgagtactacttattactgctagttcctttaaatacggcnccactctcgtgtttcggcgngcaccgagtcgaccgtctcggtcacgcccggggaancgtcgccccttggccactcgttcccg

SEQ ID NO: 356841 - DNA, 514 bp, Homo sapiens
  misc_feature: GZ8MTXP02I0AB7.22.36.D03.1.454.CMB.2.raw
  modified_base (273)..(273): a, c, t, g, unknown or other
  misc_feature (273)..(273): n is a, c, g, or t
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
  modified_base (316)..(316): a, c, t, g, unknown or other
  misc_feature (316)..(316): n is a, c, g, or t
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
  modified_base (366)..(366): a, c, t, g, unknown or other
  misc_feature (366)..(366): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctgtaccaacaacnccagccaaacccccatcatcattangtntcactcgtcgccctnaggagtctctcatcgcttcncagctcagtctgcacncgcctcctacatcnctggctccagtttgaggacgagtcttacttattactgtactacgtttacctttaaagtacggtacgcctactctcgttcggtttcggcggacgcgacgacgtcgaccgtcctcggtcacgccacggctcgccccgtcggtcacttccg

SEQ ID NO: 356842 - DNA, 543 bp, Homo sapiens
  misc_feature: GZ8MTXP02JNJIU.22.36.D03.1.454.CMB.2.raw
  modified_base (218)..(218): a, c, t, g, unknown or other
  misc_feature (218)..(218): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (359)..(359): a, c, t, g, unknown or other
  misc_feature (359)..(359): n is a, c, g, or t
  modified_base (450)..(450): a, c, t, g, unknown or other
  misc_feature (450)..(450): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtctttgactctgtctcctggtaccaacacaccagccaaacccccatcatcattanggtntcactcgtcggccctgaggagtctctcatcgcttctcagctccaagtctggcaacncggccctaccctaaccactcctcgtgggcctccgagtttcgaggacgtagtcttaacttattactgtctagtttacctttaaatacggtcncctactcttcgttggtttcggcgtaggtcacggtaacgtcgaccggtcctcggtcacgaacccgaaggtcctcgccccctcggtccacttccg

SEQ ID NO: 356843 - DNA, 583 bp, Homo sapiens
  misc_feature: GZ8MTXP02IX11U.22.36.D03.1.454.CMB.2.raw
  modified_base (302)..(302): a, c, t, g, unknown or other
  misc_feature (302)..(302): n is a, c, g, or t
  modified_base (326)..(326): a, c, t, g, unknown or other
  misc_feature (326)..(326): n is a, c, g, or t
  modified_base (401)..(401): a, c, t, g, unknown or other
  misc_feature (401)..(401): n is a, c, g, or t
  modified_base (410)..(410): a, c, t, g, unknown or other
  misc_feature (410)..(410): n is a, c, g, or t
  modified_base (436)..(436): a, c, t, g, unknown or other
  misc_feature (436)..(436): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgctgtgaaggtattggagtcgtgggggaggcttggtacaggccggggggtccctgacactctcctgtgcagcctctggattcacagtcagcagcaatgccatgagttcgggccncaggctccgaggggtaaggggttncgaggtgggtcgtcgggggattggggaagtgatgggtcgaccagacactacgcacgacgtccgtggacggggccngttcataancctacagagacgacttaaccgaaaanacgagtagaaatctagactaaatagtaacagacctacacgcgaccggaggaccacggtccgtactacttccgtgtacgacgaaacgtaccttcgttaacgttttcgggccgccggtaccgaccgtacggtcggggaccgaaccgggg

SEQ ID NO: 356844 - DNA, 532 bp, Homo sapiens
  misc_feature: GZ8MTXP02GSEN4.22.36.D03.1.454.CMB.2.raw
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctctgtaccaacaacaccagccaaacccccatcatcatttanggtntcactcgtcggccctcaggagtctcctcatcgcttctcagctccaagtctggccaacacggccctaccctaaaccatctctgggcctccgagtttgaggtacgagtcttacttattactgtctagtttacctttaaagtcgcgtacctacttctcgttggtttcgcggtagcacgaacgtgaccgtcgtcgtcacgcccgaaggcctacgccccctcggtcacttccg

SEQ ID NO: 356845 - DNA, 665 bp, Homo sapiens
  misc_feature: GZ8MTXP02FROJ2.22.36.D03.1.454.CMB.2.raw
  modified_base (353)..(353): a, c, t, g, unknown or other
  misc_feature (353)..(353): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctcctggtaccaacaaccacccaggaccaaaccccccaactcatcatttatggtgtcactcgtcggccctcaggacgtctcctcatcgtcttcncaggctcaaagtctacggacaacgaccggtccctaccctaaaccactctacgtcgggccttcccaggttttgaacggtacgtacgttccttaactttaacttaacttcggtactacgtttaccgtttaaaagttacggcgtaccctaacctttcgttccggttgggtttttccgggacgggttacggccgtaaacccggtaacggttacggtaaccccggttacccgttcccgggttaccgtaacggtaaccccgaaacgggtcccgttacccggtacccccccgttccgggtaccctaacccgtttccccg

SEQ ID NO: 356846 - DNA, 522 bp, Homo sapiens
  misc_feature: GZ8MTXP02GXRJ2.22.36.D03.1.454.CMB.2.raw
  modified_base (327)..(327): a, c, t, g, unknown or other
  misc_feature (327)..(327): n is a, c, g, or t
  modified_base (383)..(383): a, c, t, g, unknown or other
  misc_feature (383)..(383): n is a, c, g, or t
  modified_base (441)..(441): a, c, t, g, unknown or other
  misc_feature (441)..(441): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccagaccaaaccccccaactcatcatttatggtgtcactcgtcggccctnaggagtctcctcatcgcttctcaggctccaagtctgcaacacgccctaccctaacntctctggctcagtttgagacgagtctacttattactgtctagtttcctttaaatcgcnctactcgtcgttggtttcggcggtacgcacgagtcgaccgtctacgtcacgcccgaagctcgccccgtcggtccacttccg

SEQ ID NO: 356847 - DNA, 563 bp, Homo sapiens
  misc_feature: GZ8MTXP02I1RJH.22.36.D03.1.454.CMB.2.raw
  modified_base (562)..(562): a, c, t, g, unknown or other
  misc_feature (562)..(562): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgacaaatgtacagcctcagcgccgaggacacggccgtctacttctgtgcgaaagacctcttagttttcggccgcggcgacctacgtggggccagggcacccgtgtcaccgtctcttcacgcctccaccaacgggcccacgtccggtccttcccccgtggccgcccctgcctaccgacggacgccgacctccggagacggccacgacgcccggcccgttcggggctcggcccgtagggtcaacggtactaccgttccgacgtcgtactcgtactggacgcgggtcctggaccgaaggcgctagng

SEQ ID NO: 356848 - DNA, 535 bp, Homo sapiens
  misc_feature: GZ8MTXP02GA7B0.22.36.D03.1.454.CMB.2.raw
  modified_base (308)..(308): a, c, t, g, unknown or other
  misc_feature (308)..(308): n is a, c, g, or t
  modified_base (367)..(367): a, c, t, g, unknown or other
  misc_feature (367)..(367): n is a, c, g, or t
  modified_base (405)..(405): a, c, t, g, unknown or other
  misc_feature (405)..(405): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcttggtacaggccggggggtccctgacactctcctgtgcagcctctggattcacagtcagcagcaatgccatgagttggtccnccaggctccgagggaggggtgcaggtgggtctcggggattgggaagtgagtggtcgccncacactacgcagactccgtgaggggccgctcatcatcnccagacgacgactaccgaaaacacagagaatctagacaaagtgtaacacgcctcagcgaccgacggacgacggccgtctacttctagtgacgaaacgacctacttacgttttcggccgccggccgtaccg

SEQ ID NO: 356849 - DNA, 574 bp, Homo sapiens
  misc_feature: GZ8MTXP02HZ3UR.22.36.D03.1.454.CMB.2.raw
  modified_base (221)..(221): a, c, t, g, unknown or other
  misc_feature (221)..(221): n is a, c, g, or t
  modified_base (253)..(253): a, c, t, g, unknown or other
  misc_feature (253)..(253): n is a, c, g, or t
  modified_base (422)..(422): a, c, t, g, unknown or other
  misc_feature (422)..(422): n is a, c, g, or t
  modified_base (447)..(447): a, c, t, g, unknown or other
  misc_feature (447)..(447): n is a, c, g, or t
tcagacatacgcgtcacgaccggtgctcgatttagctgcgtcacgatctctcttggggttttgggggggtccctgacactctcctgtgcagcctctggattcacagtcagcagcaatgccatgagttgggtccgccaggctccgaggggaaggggttgcaggtgggtctcggggattggaagtgatggtgccacacactacgcagactccgtgaggggccnttcatcatcctcagagacgattaccgaaaacncagtgaatctgacaaatgtacagcctcagcgccgaggacacggccgtctacttctgtgacgaaagtccttacttagttttggccgcggccgacctacgtcggggccacgggcacccgttggccaccgtctcgtcacgcctcaccgaaggcccagtccgtccttccccgngccgcccctgcctccgaggacaccnccgtccgagacgcacgacgccgcccgtcgggcgtcgccgttaggacgaacggtacctaccgtttaccgacggtcgttaacgtcgtacgtggacggccgggtcgtacgggcgaacggcgacgtagtag

SEQ ID NO: 356850 - DNA, 694 bp, Homo sapiens
  misc_feature: GZ8MTXP02G81RY.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtggcggtgaaggtatggagtcgtgggggaggcttggtacaggccggggggtccctgacactctcctgtgcagcctctggattcacagtcagcagcaatgccatgagttgggtcccgccaggcctccgaggggaaggggttgcgtagggtgggtcgtcgggggattgggaaaggtgacgtgggtcacccacactaccgtacgccgaagtacctccgggtggaccggggggccctcgtttaccacgtcaacttcctaccgaaggaacgaacgtaacttaacccgaaaaacaacgtacgtagtaaaactcgtacgaactaaaatacggtaaccaacgtccctacgaacggcccggaccggaacgggaacccgaccggggtaccccgttaccgttaaccgtttccgtacggtacggtaaccggtaaaaccgtacccgtttacgtttaacggttttcggggccccgtaccgggtacccgtaccgttaccggtccgggggacccgaaccgggg

SEQ ID NO: 356851 - DNA, 725 bp, Homo sapiens
  misc_feature: GZ8MTXP02FZQCY.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgactattgggtctttgactctgtctcctggtaccaacaacacccagaccaaaccccccaactcatctattatggtcgtcactcgtccggccctcgaggtacgtctcctcactcgtcttctcgacggtcctaccaaacgttcgtacgaccaaaccgaccggtccctacccctaaacctacttccgtccgtcggggcccttacccgtaggttttcggaacgggtaccgtacgttaccttaaacctttaatttaccgttcggtaccttaacggtttttaacccgttttaaaagttaccgggtaccgtaccctactttccgttcgggtttcggggtttttccggggacgggtaacgggtcccgtaaacccgggtaaacggtccggttaacccggttcccgttaccgggttcccgaacccggtaacccccgtaaacggggtcccgttacccccggtcccccccggtttcgggtacccctacccgtttcccccgg

SEQ ID NO: 356852 - DNA, 564 bp, Homo sapiens
  misc_feature: GZ8MTXP02IEU2F.22.36.D03.1.454.CMB.2.raw
  modified_base (218)..(218): a, c, t, g, unknown or other
  misc_feature (218)..(218): n is a, c, g, or t
  modified_base (301)..(301): a, c, t, g, unknown or other
  misc_feature (301)..(301): n is a, c, g, or t
  modified_base (305)..(305): a, c, t, g, unknown or other
  misc_feature (305)..(305): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggtaccaacacaccagaccaaccccccatcatcattanggtntcactcgtcgccctcaggagtctctcatcgcttctcagctccaagtctggccaacgacgccctaccctaacactctctggcctccgtagtttgacggtacgtagtcttacttacttactgtctacgtttactttaaagttcggacgtcctacttcgttcgttcggttttcggcggtacggacaccggtaacgttcgacccgttccgtcggtccacgtcccgaacggtcctcgtcccccgtcggtacctaccgtttcccg

SEQ ID NO: 356853 - DNA, 548 bp, Homo sapiens
  misc_feature: GZ8MTXP02F9T0M.22.36.D03.1.454.CMB.2.raw
  modified_base (218)..(218): a, c, t, g, unknown or other
  misc_feature (218)..(218): n is a, c, g, or t
  modified_base (251)..(251): a, c, t, g, unknown or other
  misc_feature (251)..(251): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgagggaaggggttgcagtgggtctcggggattggaagtgatgggtgccacacactacgcagactccgtgagggccncttcatcatctccagagacgattaccgaaaacncagtgaatctgcaaatgtacagcctcagcgccgaggacacggccgtctacttctgtgcgaaagacctcttatttttgggccgcggccgacctacgtgggccagggcaccctggtcaccgtctcttcagcctccaccaacgggcccatcgtccttccccgtggccgccctgcctccgaggacgcaccctccgacgagccacacgccggcctcgggctcgcctggtcgaaggacctacttccacgtccgtagtcgtacgtcgagccggggcttcgggacgaaacggccgacgagtacgg

SEQ ID NO: 356854 - DNA, 651 bp, Homo sapiens
  misc_feature: GZ8MTXP02HMPW5.22.36.D03.1.454.CMB.2.raw
  modified_base (368)..(368): a, c, t, g, unknown or other
  misc_feature (368)..(368): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacgaggccgggggggtcctggacactctcctgtgcagcctctggattcacagtcagcagcaatgccatgagttggccgcgaggctccgaggggaagggttgcgaggtggggtctcggggattgggaagtgacgtgggtgccanacactacgcagacctccggtagggacggggccgtcttccgaatcaacttccaccgaaggtaacgacgaaacgttaacccgaaaaaacaccgagtaggaaactcgtagaactaaaagtgtaacaacgcctacgacgccgaccggaacggaccgtaaccggggcccgtacttaccgttcgtcgttacggaaaccgaaacgtacccttacgtttaacggttttccgggggacccggtacccgggtaccccgaaacggttcccggtacgggggaccccaaccggggg

SEQ ID NO: 356855 - DNA, 533 bp, Homo sapiens
  misc_feature: GZ8MTXP02I4SVU.22.36.D03.1.454.CMB.2.raw
  modified_base (310)..(310): a, c, t, g, unknown or other
  misc_feature (310)..(310): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggacccaacagtgacattgggtcttttgactctgtctcctggtaccaacaacacccaggccaaacccccactcatcatttatggtntcactcgtcggccctcaggagtctctcatcgcttctcagctccaagtctgcaacacgccctccctaaccatctcgtggctccagtttgaggacgagtctacttattactgtctagttacctttaaattacggcgtacctactctcggttggtttcggcggtacggcgaccgaagtcgaaccgtctacggtcacgccgaacgctacgcccctcggtccactccg

SEQ ID NO: 356856 - DNA, 522 bp, Homo sapiens
  misc_feature: GZ8MTXP02JAA2C.22.36.D03.1.454.CMB.2.raw
  modified_base (215)..(215): a, c, t, g, unknown or other
  misc_feature (215)..(215): n is a, c, g, or t
  modified_base (247)..(247): a, c, t, g, unknown or other
  misc_feature (247)..(247): n is a, c, g, or t
  modified_base (406)..(406): a, c, t, g, unknown or other
  misc_feature (406)..(406): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccncttcatcatctccagagacgattccgaaaacncagtgaatctgcaaatgtacagcctcagcgccgaggacacggccgtctactctgtgcgaaagcctctattttgggccgcggccgactactggggcagggcaccctggtcaccgtctcttcagcctccaccaagggcccatccggtcctccccctggccnccccgtgcctccaggcgccacctccgagacgccacgacgccggcccgtggggcctgcctggtcaaggcctacttccacgtcgtactcgtctgagccggctcggcaaggcgcagtag

SEQ ID NO: 356857 - DNA, 519 bp, Homo sapiens
  misc_feature: GZ8MTXP02IRCLK.22.36.D03.1.454.CMB.2.raw
  modified_base (304)..(304): a, c, t, g, unknown or other
  misc_feature (304)..(304): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaggtgtcaagtgtgcggtgaaggtattggagtctgggggaggcttggtacaggccggggggtccctgacactctcctgtgcagcctctggattcacagtcagcagcaatgccatgagtggtccnccaggctccaggggagggttgcgagtgggtctcggggattggagtgatggtgccacacactacgcagactcgtgagggcgcttcatcatctccagagacgatccgaaaacacagtgaatctgacaaatgtacagctcacgcgccgacggaccacggccgtactacttctcgtcgacgaaacgacctacgtacgttttcggccgtcggaccgtacg

SEQ ID NO: 356858 - DNA, 505 bp, Homo sapiens
  misc_feature: GZ8MTXP02JX20A.22.36.D03.1.454.CMB.2.raw
  modified_base (217)..(217): a, c, t, g, unknown or other
  misc_feature (217)..(217): n is a, c, g, or t
  modified_base (248)..(248): a, c, t, g, unknown or other
  misc_feature (248)..(248): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (420)..(420): a, c, t, g, unknown or other
  misc_feature (420)..(420): n is a, c, g, or t
  modified_base (429)..(429): a, c, t, g, unknown or other
  misc_feature (429)..(429): n is a, c, g, or t
  modified_base (503)..(503): a, c, t, g, unknown or other
  misc_feature (503)..(503): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccgnttcatcatctccagagacgattccgaaaacncagtgaatctgcaaatgtacagcctcagcgccgaggacacggccgtcacttctgtgcgaaagacctctatttttgggccgcggccgacctacgtggggccaggggcaccctggtccaccgtctcttcagcctccaccaagggcccatcggctccccngcnccctgctcagcncacctcgangcacagcgccctgggctcgcctggcaacggactactccacgccgtatcgtctgacgcggctggcaaggcacgancg

SEQ ID NO: 356859 - DNA, 561 bp, Homo sapiens
  misc_feature: GZ8MTXP02IHQ8Q.22.36.D03.1.454.CMB.2.raw
  modified_base (399)..(399): a, c, t, g, unknown or other
  misc_feature (399)..(399): n is a, c, g, or t
  modified_base (467)..(467): a, c, t, g, unknown or other
  misc_feature (467)..(467): n is a, c, g, or t
  modified_base (497)..(497): a, c, t, g, unknown or other
  misc_feature (497)..(497): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattgggagtcgtgggggaggcttggtacaggccgggggggtccctggacactctcctgtgcagcctctggattcacagtcagcagcaatgccatgagttgggtcccgccaggctccgaggggaaggggttgcgaggtgggtctcggggattgggaagtgatggtcgccacacactacacagactccggtgacgggggccncttcatcatctccagagacgacttaccgaaaacacagtagaaatctagactaaagtgtacagccctanacgcgccggaggacacggcctcgtacttcngtcgacgtaaacgaccttcttacgttttcgggcccgtcggccgacgtacgtcggggaccacggg

SEQ ID NO: 356860 - DNA, 706 bp, Homo sapiens
  misc_feature: GZ8MTXP02H4ZEO.22.36.D03.1.454.CMB.2.raw
  modified_base (423)..(423): a, c, t, g, unknown or other
  misc_feature (423)..(423): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggcttggtacgagggccggggggtccctgacactctcctgtcgcacgcctcgtggattcacagtcagcagcaatgcatgaggtttggccgccaggcctccgaaggggtaaggggttgcgtagggtgggtcgcgggggtatttggggaaagttcgagtgggtcgccatacacgtacgccaaggtacctccggtggacgggggcccntttcaattccaatcctaccgaagacgaacgtacgttaaacccgaaaaacaccgtagtaacggtaaaactcgttacggaacttaaaagtacgttaaaccgacgacccttaaccggacggacccggacccgggaaacggtaaccgaaacccggggtacccggttcttaacccgtttcgtacgttacggaaccgtaaaaccgtacccgttacgtttaaccggtttttcggggcccgtaccgggacccggtaaaccgtaccgggttcggggacccgtaacccggggg

SEQ ID NO: 356861 - DNA, 628 bp, Homo sapiens
  misc_feature: GZ8MTXP02JXC3Y.22.36.D03.1.454.CMB.2.raw
  modified_base (404)..(404): a, c, t, g, unknown or other
  misc_feature (404)..(404): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtatggagtcgtgggggaggcttggtacaggccgggggggtccctgacactctcctgtgcagcctctggattcacagtcagcagcaatgccatgagttgggtcccgcgaggctccgaggggaaggggtttgcgaggtggggtcgtcggggattgggaagtgagtgggtgcccacacacgtacgccagacctccgtggagggggcccncttcgatcatcctccagacgacgacttaccgaaaacaccgagtagaatcgtagacaaatagtacacgcctcgaacgccggaccgaggaccgaccgggcccgttacctaacgttcccgtggttacggacgtaaaacggtacccctttacgtttaacgtttttccgggggacccggtccggggtacccggtaccgttaaccgggttcgggggacccgaaccggggg

SEQ ID NO: 356862 - DNA, 603 bp, Homo sapiens
  misc_feature: GZ8MTXP02J28GD.22.36.D03.1.454.CMB.2.raw
  modified_base (280)..(280): a, c, t, g, unknown or other
  misc_feature (280)..(280): n is a, c, g, or t
  modified_base (327)..(327): a, c, t, g, unknown or other
  misc_feature (327)..(327): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggagcttggtacaggcccggggggtccctggacactctcctgttcagccctctggattcacngtcagcagcaatgccatgagttggccgcaggctccgagggagggttncgaggtgggtctcggggattgggaagtgacgtggtgccacgcacgtacgcagacctccggtggacggggcccgcgttcactcactctccgagacgacgaacgttaccgaaaacacagtacgaatcgtagactaaagtcgtaccgagaccctacgacgccgaccggacggaaccgaccggcccgtaccttaccttcgtcgtacgaccggtaaaacgtaacccgttacgtttaacgtttttcggggacccggtccggtacccgtacgttaacccgggg

SEQ ID NO: 356863 - DNA, 519 bp, Homo sapiens
  misc_feature: GZ8MTXP02G0124.22.36.D03.1.454.CMB.2.raw
  modified_base (310)..(310): a, c, t, g, unknown or other
  misc_feature (310)..(310): n is a, c, g, or t
  modified_base (341)..(341): a, c, t, g, unknown or other
  misc_feature (341)..(341): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcagtcaccatctcctgcactggaaccagcagtgacgttggtggttacaagtatgtctcctggtaccaacaccacccaggccacacgcccccaaaactcatgatttangaggtcactaaagcggctcaggggtcccccngatcgcttctctggctcaagtctggcacacggcctccctgacccgtctcgtgggctccgaggctgaggctggagctgattagtactgctactcatatgcaggcgactaactcgttgggtcgttcgggcggtacgggaccaagctggacccgtcgtacgggtcacgcccgaaggtcccg

SEQ ID NO: 356864 - DNA, 570 bp, Homo sapiens
  misc_feature: GZ8MTXP02JSRZ7.22.36.D03.1.454.CMB.2.raw
  modified_base (216)..(216): a, c, t, g, unknown or other
  misc_feature (216)..(216): n is a, c, g, or t
  modified_base (302)..(302): a, c, t, g, unknown or other
  misc_feature (302)..(302): n is a, c, g, or t
  modified_base (321)..(321): a, c, t, g, unknown or other
  misc_feature (321)..(321): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggtaccaacaacacccaggccaaaccccccatcatcattangtgtcactcgtcggccctnaggagtctctccatcgtcttctcaggctccaagtctggacaacgacggccctaccctaaccatcctcgtcgggccttcccgtagtttcgacggtacgtagtaccttactttattactgtactagtttacctttaaagttcggcctcctacgttctcggttggtttcggacggtacgtacaccggtagtcgtacccgtccgtcgtcacgcccgtaaggccctacggccccctggcctaccgtcttccccg

SEQ ID NO: 356865 - DNA, 608 bp, Homo sapiens
  misc_feature: GZ8MTXP02G5KCD.22.36.D03.1.454.CMB.2.raw
  modified_base (219)..(219): a, c, t, g, unknown or other
  misc_feature (219)..(219): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaaccaacagtgactagttggtctttgactctgtctctggtaccaacacaccagaccaaacccccactcactcatttatgtcgtcactcgtcgcccctgaggtacgtctcctcacttcgtcttctccaggcctaccaagtcgtacggaccaaaccgaccggacccccttaaccctaaaccctactcctcgtcgggccttaccgtagtttcggaacgggtactacgttacttacttaatttcgtacgtacttacgtttactttaaagtacggcctacctacgtcgttcggttcgggtttcggacggtacggacctaacggtaacgtcggacccgttcgtccgtacgacgccgacgccgtcgccccgtcgtacctcgttcccg

SEQ ID NO: 356866 - DNA, 558 bp, Homo sapiens
  misc_feature: GZ8MTXP02HRLZO.22.36.D03.1.454.CMB.2.raw
  modified_base (405)..(405): a, c, t, g, unknown or other
  misc_feature (405)..(405): n is a, c, g, or t
  modified_base (438)..(438): a, c, t, g, unknown or other
  misc_feature (438)..(438): n is a, c, g, or t
  modified_base (486)..(486): a, c, t, g, unknown or other
  misc_feature (486)..(486): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattgggagtcgtgggggaggtcgttggtacgaggcccggggggtccctggacactctcctgtgcagcctctggattcacagtcagcagcaatgccatgagtcggccgccaggctcgagggtagggttgcgaggtgggtcgtcggggattgggaacgtgagtggcgcacacactacgcagacgtccggtggacggggccncttcgatcatctcagacgacgactaccgaaaancagtagatctagacaaagtcgtacagcctacgacgcgccgacggaccncggacctctacgttcgtcgtacgacgtaaacgtacgtacgtttacgtttcgggcccggtcggaccgtaaccg

SEQ ID NO: 356867 - DNA, 622 bp, Homo sapiens
  misc_feature: GZ8MTXP02JYMT5.22.36.D03.1.454.CMB.2.raw
  modified_base (363)..(363): a, c, t, g, unknown or other
  misc_feature (363)..(363): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggagcttgggtacaggccggggggtccctgacactctcctgtgcagcctctggattcacagtcagcagcaatgccatgagttgggtccgccaggctccgaggggaaggggttgcgaggtgggtctcggggattggaagtgatggngccacacgactacgcagactccggtggacggggccgctcgatcatctccagacgacgacttaccgaaaaccacagtagaactcgtacgaaccgtaaatcgtaacaacggttcccacgacggccggacccggaacggacccgaccgggcccggttaccttaaccgtccgttacggtccggtaaccggtaaaaccggtacccgttaccgtttacggttttttccgggggccccggtaccggggtaccccggtaaaccccgg

SEQ ID NO: 356868 - DNA, 586 bp, Homo sapiens
  misc_feature: GZ8MTXP02HD82F.22.36.D03.1.454.CMB.2.raw
  modified_base (364)..(364): a, c, t, g, unknown or other
  misc_feature (364)..(364): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcagcctctggattcacagtcagcagcaatgccatgagttggtccgcaggctccgagggagggttgcagtgggctcggggattggaagtgatggtgcctacncaactacgcagacctccggtggacggggccgtcgttcacgtcactcctccgagacgtacgacttaccgaaaacacgaagtagaatctagacaaatcgtacaacgcctacgacgcgacccgaacgggaaccgaccgggcccgttacctaacgtttccgtagtcgaaccgaaacgtacccgttacgttacgtttttcgggcccgtacgggtacccggtaaccgg

SEQ ID NO: 356869 - DNA, 576 bp, Homo sapiens
  misc_feature: GZ8MTXP02I45O9.22.36.D03.1.454.CMB.2.raw
  modified_base (302)..(302): a, c, t, g, unknown or other
  misc_feature (302)..(302): n is a, c, g, or t
  modified_base (400)..(400): a, c, t, g, unknown or other
  misc_feature (400)..(400): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttgggtccnccaggcctccgaggggaggggttgcgaggtgggtcgtcggggattggaagtgacgtgggtgccacacactacgcagacctccggtggacgggggcccncttcactcatcctccagaacgacgacttacccgaaaacacagtgaaatctagacaaatgtaaccacgcctacgagcgacgaggaccgccggaccgtctacttctcgtacgtacgaaacgtacctacgtttacgtttaacgggccgtcggaccgacgtacgtcggggccgtaccggg

SEQ ID NO: 356870 - DNA, 615 bp, Homo sapiens
  misc_feature: GZ8MTXP02G7AHN.22.36.D03.1.454.CMB.2.raw
  modified_base (305)..(305): a, c, t, g, unknown or other
  misc_feature (305)..(305): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggcttgggtacgaggccgggggggtccctgacactctcctgtgcagcctctggattcacagtcagcagcaatgccatgagttggccncaggctccgaggggagggtgcgaggtggtcgtcggggattgggaagtgacgtggtcgccaacacacctacgcaacgtacgtccggtggacgggggcctcttacactcaactcctccaggaacgacgtaacttaaccgaaaacacaagtagtaaatctagaactaaatagtaaccacggaccctacgacgccggaccggaacggaccgaccggacccgttctaccgttcgtcgtacgaacgtaaacgtacccttcgtttaacgttttcgggccgtccggtaccgtacgttaccggacggggaccgaccggg

SEQ ID NO: 356871 - DNA, 642 bp, Homo sapiens
  misc_feature: GZ8MTXP02ICJO4.22.36.D03.1.454.CMB.2.raw
  modified_base (236)..(236): a, c, t, g, unknown or other
  misc_feature (236)..(236): n is a, c, g, or t
  modified_base (254)..(254): a, c, t, g, unknown or other
  misc_feature (254)..(254): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcattttcctgcactggggaaccaaanagtgactagtttgggttnttttgtctctgtctcctacgtaaccaaaccaaaccaaccccaaccgaaccccaaacccccccaaccctacactactattatgtcgtctactcgtccgccctcgacgtactctcctctactctcttctcgcgtctacctaacgtcgtcgtaccaaccgaccgacccctacccctaacctactctcgtcggtcgtacgtacgttgtacgtacgtacgttactacttacttactacgtacgttacgtttacgtttaaacgttaacgtacgtacctacgtcgttcggttcgggtttcgggtcgggtacggtacgtaccgtacgtacgtaccgtaccgtcgtacgtaccgtaaccgtacgtaccgtccgtccccgtcccgtccgtaccgtccg

SEQ ID NO: 356872 - DNA, 643 bp, Homo sapiens
  misc_feature: GZ8MTXP02G4J0T.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcttggtacgaggccggggggtccctgacactctcctgtgcagcctctggattcacagtcagcagcaatgccagtgaggtttcgggcccgccgaggcctaccgaaggggaagggttgcgaggtgggtcgtggggattggggaaagtgagtgggtcgacccaacacacctacggcgaagtaccgtccggtagggacggggccgtcttcgatcatcctccaggaacgacgtaactaacccgaaaactacgagtacgtaaatctaagaactaaaagtcgtaacgacgccctacgaacgccgaaccggagaccgaccggtcccgtacttaccgttcgtcgtacggaacgtaaacgtacccttacgtttacgttttccggggcccgtaccgggacccgtaacgtaccgggtacggggcccgtaacccggg

SEQ ID NO: 356873 - DNA, 568 bp, Homo sapiens
  misc_feature: GZ8MTXP02JKFHM.22.36.D03.1.454.CMB.2.raw
  modified_base (300)..(300): a, c, t, g, unknown or other
  misc_feature (300)..(300): n is a, c, g, or t
  modified_base (355)..(355): a, c, t, g, unknown or other
  misc_feature (355)..(355): n is a, c, g, or t
  modified_base (373)..(373): a, c, t, g, unknown or other
  misc_feature (373)..(373): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
  modified_base (431)..(431): a, c, t, g, unknown or other
  misc_feature (431)..(431): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggagcttggtacagccggggggtccctgacactctcctgtgcagcctctggattcacagtcagcagcaatgccatgagttgggtcccncaggctccgagggagggttgcagtgggtctcgagggatggaatgatggtgaccanacactcgcagacctccgngacggggccncgtcatcanctccagagacgattaccgaaaacacagtagaaatcgtanacgtaaatggtaacagcctcgaagccgaccgagggaccaccgggtcctcgtacttccgtaggtcgaccgaaaacggtcccttacgttaagttttcggggcccggtaccggtacccgacgtaacggtcggggacccgg

SEQ ID NO: 356874 - DNA, 502 bp, Homo sapiens
  misc_feature: GZ8MTXP02JLFSW.22.36.D03.1.454.CMB.2.raw
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
  modified_base (501)..(501): a, c, t, g, unknown or other
  misc_feature (501)..(501): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccncttcatcatctccagagacgattccgaaaacncagtgaatctgcaaatgtacagcctcagcgccgaggacacggccgtctacttctgtgcgaaagacctctatttttgggccgcggccgacctacgtggggccaggggcaccctggtcaccgtctcttcagctcaccaaggcccatcggctccctgcncctgctcagcncacctcgagcgcacagccggccctgggctgcctgtcaaggactacttccacgcgtatcgtctgacgcggctcggcaaggcgacagng

SEQ ID NO: 356875 - DNA, 621 bp, Homo sapiens
  misc_feature: GZ8MTXP02IB3EC.22.36.D03.1.454.CMB.2.raw
  modified_base (368)..(368): a, c, t, g, unknown or other
  misc_feature (368)..(368): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcagccctctggattcacagtcagcagcaatgccatgagttgggcccgccgaggctccgaggggaaggggttgcgaggtgggtcgtcggggattggaagtgagtggtgccanacactacgcagactccgtgacgggcgcttcgatcgatctcagacgacgacttaccgaaaacacgagtacgaatctagactaaaatgtaacacgcctacgaacgccgaccggaaggacccgaaccgggcccgttacctaaccgtttccgaggttacggaacgtaaaacggtacccttacgtttaacggtttttccggggcccgcccgggtacccggtaaccgtttaccgggtccgggggtacccgacccggggg

SEQ ID NO: 356876 - DNA, 523 bp, Homo sapiens
  misc_feature: GZ8MTXP02JEYQZ.22.36.D03.1.454.CMB.2.raw
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
  modified_base (408)..(408): a, c, t, g, unknown or other
  misc_feature (408)..(408): n is a, c, g, or t
  modified_base (422)..(422): a, c, t, g, unknown or other
  misc_feature (422)..(422): n is a, c, g, or t
  modified_base (433)..(433): a, c, t, g, unknown or other
  misc_feature (433)..(433): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattccgaaaacncagtgaatctgcaaatgtacagcctcagcgccgaggacacggccgtctacttctgtgcgaaagcctctagtttttcggccgcggccgacctacgtcggggccagggcacccgtggtcaccgtctcttcagcctccacaacgggccatcgtctcccctgcnccctgctccagacncacctccgagngccacacgccggccgtgggcctgcccgtggtacaacggcctacgttcccacgcgtatcgtctggagcggcgtcggcgaaggcgacactag

SEQ ID NO: 356877 - DNA, 569 bp, Homo sapiens
  misc_feature: GZ8MTXP02GYQIP.22.36.D03.1.454.CMB.2.raw
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (323)..(323): a, c, t, g, unknown or other
  misc_feature (323)..(323): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggacccaacagtgacattgggtcttttgactctgtctcctgtaccaacaacacccaggccaaaccccccatcatcattanggtntcactcgtcgccctnaggatctcctcatcgcttctcaggctccaagtcctggaccaacgaccggccctaccctaaacactcctcgtgggcctccgtacgtttgaaggtacgagtctaacttattactgtactagtttacctttaaatacggctacctactcttcgttcggtttcggcggtacggccacggtaacgttcgacccgtcctcggtaccacgaacccgaagggtcctcgccccccgtggtaccctacgtttcccg

SEQ ID NO: 356878 - DNA, 533 bp, Homo sapiens
  misc_feature: GZ8MTXP02FVXD3.22.36.D03.1.454.CMB.2.raw
  modified_base (307)..(307): a, c, t, g, unknown or other
  misc_feature (307)..(307): n is a, c, g, or t
  modified_base (331)..(331): a, c, t, g, unknown or other
  misc_feature (331)..(331): n is a, c, g, or t
  modified_base (347)..(347): a, c, t, g, unknown or other
  misc_feature (347)..(347): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtcttttgactctgtctcctggtaccaacaacacccaggaccaaaccccccaactcatcatttanggtgtcactcgtcggccctcaggngtctctcatcgcttcncaggctcaagtctggcaacacgcctccctaacatctcgtgggctccagtttgacggacgaagtctaacttattactgactagtttacctttaaaagttagcgtaccacttctcgtggttttcggcggtacgcaccgaagtcgaccgtccgtcggtcacgcccaaggctcgccccctcggcacgttc

SEQ ID NO: 356879 - DNA, 655 bp, Homo sapiens
  misc_feature: GZ8MTXP02FRUTO.22.36.D03.1.454.CMB.2.raw
  modified_base (399)..(399): a, c, t, g, unknown or other
  misc_feature (399)..(399): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttgggtcccgccaggctccgaggggaaggggttgcgaggtgggtcgtcggggattggaagtgagtggtgccacacacgtacgcagaccgtccggtggacggggccncttcactcactctccagagacgacttaccgaaaacacagtagaatctagactaaatcgtaaccgacgacccgtacacggaccgacccgggaaggaaccggaccgggtacccgtaccttaaccgtttccggttacggttacggaaaccggtaaaaccggtacccgttaccgttttaacgttttttaaccgggggccccggtacccggggtacccggtaacccggttaccggttcgggggaccccggtaacccggggg

SEQ ID NO: 356880 - DNA, 580 bp, Homo sapiens
  misc_feature: GZ8MTXP02H4KKH.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctatttaaaaggtgtcaagtgtgcggtgaaggtattggagtcgtgggggaggcttgggtacaggccgggggggtccctgacactctcctgtgcagcctctggattcacagtcagcagcaatgccatgagttggccgcaggctaccgagggaacggggttgcgaaggtggggtcgtcggggattgggaagtggagtggtgccagacactaccgcagacgtccggtggacgggggccgcgttcactcattctaccagacgaacgacttaaccgaaaacaacagtagaatctgacaaatcgtacacgctacagcgaccgacggacaccgggcctacgtacttcgtcgttcggaacgtaaacggtacccttacgtttaacgtttttcgggcccgttccgggaccgtaacccgg

SEQ ID NO: 356881 - DNA, 607 bp, Homo sapiens
  misc_feature: GZ8MTXP02HMMHQ.22.36.D03.1.454.CMB.2.raw
  modified_base (306)..(306): a, c, t, g, unknown or other
  misc_feature (306)..(306): n is a, c, g, or t
  modified_base (326)..(326): a, c, t, g, unknown or other
  misc_feature (326)..(326): n is a, c, g, or t
  modified_base (369)..(369): a, c, t, g, unknown or other
  misc_feature (369)..(369): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatgccatgagttgggccncaggctccgagggagggttncgaggtggggtcgtggggatttggggaagtgagtggtcgaccncacactacgcaacgacgtccggtgggacggggcccgcgttcactacactcgtaccagacgaacgaacttacccgaaaaacaccgtagtacggtaatccgtagacaaacgtcgttaacacggacctcgacgaccgcccggaacggaccgaccggacccggttctaccgtttcgacgttacggaccgtaaagtacccgttacgttacggttttcgggccggtaccggacccggtaaccgg

SEQ ID NO: 356882 - DNA, 599 bp, Homo sapiens
  misc_feature: GZ8MTXP02HM3UW.22.36.D03.1.454.CMB.2.raw
  modified_base (217)..(217): a, c, t, g, unknown or other
  misc_feature (217)..(217): n is a, c, g, or t
  modified_base (306)..(306): a, c, t, g, unknown or other
  misc_feature (306)..(306): n is a, c, g, or t
  modified_base (387)..(387): a, c, t, g, unknown or other
  misc_feature (387)..(387): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgccctccgtgtctggatcatctggacagtcgatcagcatttccngcactgggaccaacagtgacagttgggtcttttgactctgtctcctggtaccaacacacccagccaaaccccccatcatcattatggtntcactcgtcgccctcaggagtctctccatcgtcttctcacggctccaagtctcggacaaccgaccgccctaccctaaaccnctcctcgtcgggtcctcccgtaggtttcgaggtacgtagttctactttattacctgtaccttagtttaccctttaaagtacggtcctaccctacgttaccgttcggttcgggttttccgggacgggtacggtccgtaaccgggtaagtccggtaccgtccgtccggtccacgcccgtaacgcctccgtccccctggtcctacgtccttcccg

SEQ ID NO: 356883 - DNA, 582 bp, Homo sapiens
  misc_feature: GZ8MTXP02GRPWE.22.36.D03.1.454.CMB.2.raw
  modified_base (368)..(368): a, c, t, g, unknown or other
  misc_feature (368)..(368): n is a, c, g, or t
  modified_base (396)..(396): a, c, t, g, unknown or other
  misc_feature (396)..(396): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcttggtacaggcccgggggggtccctgacactctcctgtgcagcctctggattcacagtcagcagcaatgccatgagttgggtccgccaggctccgaggggaaggggttgcgaggtgggtctcggggattgggaagtgagtggtgccanacactacgcagactccgtgacggggccncttcatcactctaccagagacgacttaccgaaaacacagtagaatctgacaaatagtaacagcctacacgcgaccgaggaccgacggccgtctacttctcgtacgacgaaacgtacccttacgttaacgtttttcggggcccgtaccgggacccggtaccgttaccggtcggggaccgaaccgggg

SEQ ID NO: 356884 - DNA, 580 bp, Homo sapiens
  misc_feature: GZ8MTXP02F9IB4.22.36.D03.1.454.CMB.2.raw
  modified_base (217)..(217): a, c, t, g, unknown or other
  misc_feature (217)..(217): n is a, c, g, or t
  modified_base (250)..(250): a, c, t, g, unknown or other
  misc_feature (250)..(250): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattaccgaaaacncagtgaatctgcaaatgtacagcctcagcgccgaggacacggccgtctacttctgtgacgaaagcctcttagttttcgggccgcggccgacctacgtcggggccacgggccacccgtggtccaccgtctcttcacgtcctccacccgaacgggcccacgttccggtcccttcccccgtggcccgccccttgccctccgacggacgccacccgtccgagacgaccacgacgccggcccgtggggcctcggcccgtggtccgaaacggtaccttaccgttccgaacgtcgtacgtcgtctggacggcgggctcgggacgaggcgacagtacg

SEQ ID NO: 356885 - DNA, 595 bp, Homo sapiens
  misc_feature: GZ8MTXP02JYRZA.22.36.D03.1.454.CMB.2.raw
  modified_base (305)..(305): a, c, t, g, unknown or other
  misc_feature (305)..(305): n is a, c, g, or t
  modified_base (449)..(449): a, c, t, g, unknown or other
  misc_feature (449)..(449): n is a, c, g, or t
  modified_base (507)..(507): a, c, t, g, unknown or other
  misc_feature (507)..(507): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggagcgttggtacgaggccggggggtccctgacactctcctgtgcagcctcgtggattcacagtcagcagcaatgccatgagttgggtccnccaggctccgaggggaagggttgcgaggtgggtcgtcggggtattgggaaggtgacgtgggtcgccacacactacgcacgactccggtggacggggcctcttcactcaactcctaccgaagacgacgtacttacccgaaaaacncgagtacgaaatcctagacaaaagtgtaaccagccctacgacgccgaccggaggaccncgggccttactactcgtcgtacgacgaaaacgcccttgttacgtttcgggcccgtacggtcccgacgttacggcggggacccgacggg

SEQ ID NO: 356886 - DNA, 562 bp, Homo sapiens
  misc_feature: GZ8MTXP02J22M7.22.36.D03.1.454.CMB.2.raw
  modified_base (306)..(306): a, c, t, g, unknown or other
  misc_feature (306)..(306): n is a, c, g, or t
  modified_base (408)..(408): a, c, t, g, unknown or other
  misc_feature (408)..(408): n is a, c, g, or t
  modified_base (423)..(423): a, c, t, g, unknown or other
  misc_feature (423)..(423): n is a, c, g, or t
  modified_base (438)..(438): a, c, t, g, unknown or other
  misc_feature (438)..(438): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacgaggccgggggggtccctggacactctcctgtgcagcctctggattcacagtcagcagcaatgccatgagttgggtccnccgaggctccgaggggtaacggggttgcgaggtggggtctcggggattgggaagtgagtgggtgcccacacacgtacgcagacctccggtgacgggggcccnttcatcatcctcagnacgatacccgaaaancagtgaaacttcgagacaaaatcgtaacagccctcacgcgccgacgacgacgcgtctactctcgtcgacgaacgacctacttacgtttcggtccggccggccgaccgtacgtcgggcgaccggg

SEQ ID NO: 356887 - DNA, 558 bp, Homo sapiens
  misc_feature: GZ8MTXP02JEVBC.22.36.D03.1.454.CMB.2.raw
  modified_base (306)..(306): a, c, t, g, unknown or other
  misc_feature (306)..(306): n is a, c, g, or t
  modified_base (321)..(321): a, c, t, g, unknown or other
  misc_feature (321)..(321): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccagccaaaccccccatcatcatttatgtntcactcgtcgccctnaggagtctcctcatcgcttctcagctccaagtctgcaacgacggccctaccctaaccatctctgggctccgagtttgaggacagtctacttattactgtctacgtttacctttaaagttacggccgtacctacttccgttcggttgggttttcggcggtacggccaaccggtaagtcgaacccgttccgtacggtctacggcccgaaggcctccgcccccttcggtccacgtttccg

SEQ ID NO: 356888 - DNA, 554 bp, Homo sapiens
  misc_feature: GZ8MTXP02FOKJU.22.36.D03.1.454.CMB.2.raw
  modified_base (398)..(398): a, c, t, g, unknown or other
  misc_feature (398)..(398): n is a, c, g, or t
  modified_base (431)..(431): a, c, t, g, unknown or other
  misc_feature (431)..(431): n is a, c, g, or t
  modified_base (512)..(512): a, c, t, g, unknown or other
  misc_feature (512)..(512): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctgacactctcctgtgcagcctctggattcacagtcagcagcaatgccatgagttgggtccgccaggctccaggggaaggggttgcgaggtgggtcgtcggggattgggaaagtggatgggtgccacacactacgcagactccggtgagggggccncttcatcatctccagagacgattaccgaaaacncagtagaaatctagacaaatgtaacagccctcacgcgaccgaggacacggccgtactacttctcgtcacgaaacgaccctnttagtttcgggccgtcggccgtacgtacgtcggggccacggg

SEQ ID NO: 356889 - DNA, 573 bp, Homo sapiens
  misc_feature: GZ8MTXP02HZYDJ.22.36.D03.1.454.CMB.2.raw
  modified_base (327)..(327): a, c, t, g, unknown or other
  misc_feature (327)..(327): n is a, c, g, or t
  modified_base (402)..(402): a, c, t, g, unknown or other
  misc_feature (402)..(402): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacgaggccgggggggtccctgacactctcctgtgcagcctctggattcacagtcagcagcaatgccatgagttgggccgccaggctccgaggggaggggttncgaggtggggtcgtcggggattgggaagtgagtggtcgccacgacactacgcacgactcccgtgacgggggcccnttcatcactcctccagagacgacttaccgaaaacacagtagaatctagactaaatgtacagcctcgacgccggcgacggaccgacggccgtctacttcgtcgtcgacgaaacgtacctcgttacgttttcgggcccggtcggcccgacgtaccggtcggggccgaccgggg

SEQ ID NO: 356890 - DNA, 576 bp, Homo sapiens
  misc_feature: GZ8MTXP02JARKS.22.36.D03.1.454.CMB.2.raw
  modified_base (306)..(306): a, c, t, g, unknown or other
  misc_feature (306)..(306): n is a, c, g, or t
  modified_base (390)..(390): a, c, t, g, unknown or other
  misc_feature (390)..(390): n is a, c, g, or t
tcagacatacgcgtcacgaccggtgctcgatttagctgcgtcacgatctctcttggggagctctgagagaggagcccagcccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggatcacagtcagcagcaatgccatgagttggccncaggctccgagggagggttgcagtggtcgtcggggattgggaagtgagtggtgccacacactacgcagactccgtgacgggccnttcatcagtctaccagacgacgacttaaccgaaaacacgagtacgaatctacgaacaaatcgtaacacgcctacgaacgccgaccgacggaccgaccggtcccgtactaacgttcgtacgtacgaaccgtaaaacgtcccgttacgtttaacggttttccgggaccgtaccgggtaccgtaaccgg

SEQ ID NO: 356891 - DNA, 601 bp, Homo sapiens
  misc_feature: GZ8MTXP02HYRRI.22.36.D03.1.454.CMB.2.raw
  modified_base (366)..(366): a, c, t, g, unknown or other
  misc_feature (366)..(366): n is a, c, g, or t
  modified_base (401)..(401): a, c, t, g, unknown or other
  misc_feature (401)..(401): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccggggggtccctgacactctcctgtgcagcctctggattcacagtcagcagcaatgccatgaggtttgggcccgccaggctccgaggggaaggggttgcgaggtggggtcgtcggggattgggaagtgatgggtnccacacactacgcagactcccggtgacgggggccncttcatcatcctccagacgacgacttaccgaaaacacagtagaaatcgtagacaaagttacgtacacgacctacgacgccgaccggacggaccgaccggacccgtctaccgttcgtcgtcggacgtaaacgtaccgttactttacgtttttcgggcccggtaccggacccgtaccgtaccggtcggggacccgaccgggg

SEQ ID NO: 356892 - DNA, 564 bp, Homo sapiens
  misc_feature: GZ8MTXP02F1Y2N.22.36.D03.1.454.CMB.2.raw
  modified_base (399)..(399): a, c, t, g, unknown or other
  misc_feature (399)..(399): n is a, c, g, or t
  modified_base (434)..(434): a, c, t, g, unknown or other
  misc_feature (434)..(434): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctgacactctcctgtgcagcctctggattcacagtcagcagcaatgccatgagttgggtccgccgaggctccgaggggaaggggttgcgaggtgggtcgtcggggattggggaagtgagtggtgccacacactacgcagactccgtgacgggggccnttcatcactctccagacgacgacttaccgaaaacncagtagaatctagacaaatgtaacagcctacagcgccgagacgacggctctactctagtcgacgtaaacgccttacgttacgttttcggggcccgtacggtacccgacgtacggtcggggaccgtacggg

SEQ ID NO: 356893 - DNA, 667 bp, Homo sapiens
  misc_feature: GZ8MTXP02I369O.22.36.D03.1.454.CMB.2.raw
  modified_base (219)..(219): a, c, t, g, unknown or other
  misc_feature (219)..(219): n is a, c, g, or t
  modified_base (308)..(308): a, c, t, g, unknown or other
  misc_feature (308)..(308): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtggaccaacagtgactagttggttctttgactctgtctcctgtaccaacaccaccacgacccaaacccccatcatcattatgtntcactcgtccgccctgaggactctcctactatacgccttctcgacggcctacctaagtctacggacaaccgaccgtccctaccctaaacctacttcctcgtcggtcctacccgtagtttacggacggtaaccgtagtacttactttaattactcgtacttacgtttaacctttaaagtacggtcctacctacgttcgttcggttacgggttttcgggacggtacgggtaccgtaaccggtacggttcccggtaacccgttcccgttaccggggttaacctaacccgggaacccccggtaaacgggcccgtttacccccggaccccccgtttccggggttaccctacccggtttcccccg

SEQ ID NO: 356894 - DNA, 610 bp, Homo sapiens
  misc_feature: GZ8MTXP02IE7MF.22.36.D03.1.454.CMB.2.raw
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctattttccngcacgtcggaaccaanagtgactagtttggttctttgctctgtctccgtacgtaaccaacaaccacccacgaaccccaaacccccatacatctattagtgtctctactcgtccgcctagaggtctctcctactactctcttcacgacgtcctaccgtaagtccgtacgaccaacgtaccgtacccctaccctaactacttcgtcgtcggctacgtagttacggacgtacgtacgtacttaacttattactagtacttacttaacttaaagtcgactactacttcgttggttcggttcggacggtacgtacgacggtacgtacggtaccgtccgtacggtacacgtaacccgtaacggtcccgtccgtccccgttacggtacctaccttccg

SEQ ID NO: 356895 - DNA, 626 bp, Homo sapiens
  misc_feature: GZ8MTXP02F9A41.22.36.D03.1.454.CMB.2.raw
  modified_base (305)..(305): a, c, t, g, unknown or other
  misc_feature (305)..(305): n is a, c, g, or t
  modified_base (399)..(399): a, c, t, g, unknown or other
  misc_feature (399)..(399): n is a, c, g, or t
  modified_base (442)..(442): a, c, t, g, unknown or other
  misc_feature (442)..(442): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctggacactctcctgtgcagcctctggattcacagtcagcagcaatgccatgagttgggtccncaggctccgaggggaggggttgcgaggtgggtcgtcggggattgggaagtgagtggtgccacgacactacgcagacctccggtgacgggggccncttcgactcaatcctaccagacgaccacgttacccgaaaaacncaagtgaaatcgtagaactaaatcgtaacgacgaccctacgaacggcccgaccggacggacccgacgggcccgttactaaccgtttcgacggtcgaacgtaaaaccgtacccttaccgtttaaggtttttccgggggcccgtaccggggtacccgacgtttaccggcgggggacccgaccgggg

SEQ ID NO: 356896 - DNA, 587 bp, Homo sapiens
  misc_feature: GZ8MTXP02INA9I.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccattgagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttgggccgcaggctccgaggggagggttgcaggtgggtctcggggattggaagtgacgtggtgccacacacctacgcagacctccggtgacgggggccgcttcgatcactctccagacgacgattaccgaaaacacagtagaaatctagacaaatgtaacacgcctcacgcgaccggacggaccgacggcccgtactaccttcgtcggttacgacggtaaaacgaacccttcgtttaacggtttttcgggcccggtacgggcccggtacgtaccggtcgggggaccgaccgggg

SEQ ID NO: 356897 - DNA, 642 bp, Homo sapiens
  misc_feature: GZ8MTXP02G3VSA.22.36.D03.1.454.CMB.2.raw
  modified_base (303)..(303): a, c, t, g, unknown or other
  misc_feature (303)..(303): n is a, c, g, or t
  modified_base (397)..(397): a, c, t, g, unknown or other
  misc_feature (397)..(397): n is a, c, g, or t
  modified_base (430)..(430): a, c, t, g, unknown or other
  misc_feature (430)..(430): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccggggggtccctgacactctcctgtgcagcctctggattcacagtcagcagcaatgccatgagttgggtccnccgaggctccgaggggaggggttgcgaggtggggtctcggggattgggaagtgagtggtgccacacactacgcagacgtccgtggacggggccncttcatcatctccagagacgactaccgaaaacncgagtagaatcctagactaaaatcgtaacacgccctacgacggccgacccggaaggacccgacggggtccccgttacgttaacccgtttcgttacggtacggaacccggtaaaacgtaccccgtttacgtttaacggtttttccgggggacccccggtccgggggtaccccgtaccggttaaccgggttccggggggacccgtaaccggggg

SEQ ID NO: 356898 - DNA, 632 bp, Homo sapiens
  misc_feature: GZ8MTXP02HT8VS.22.36.D03.1.454.CMB.2.raw
  modified_base (371)..(371): a, c, t, g, unknown or other
  misc_feature (371)..(371): n is a, c, g, or t
  modified_base (397)..(397): a, c, t, g, unknown or other
  misc_feature (397)..(397): n is a, c, g, or t
  modified_base (406)..(406): a, c, t, g, unknown or other
  misc_feature (406)..(406): n is a, c, g, or t
  modified_base (425)..(425): a, c, t, g, unknown or other
  misc_feature (425)..(425): n is a, c, g, or t
  modified_base (430)..(430): a, c, t, g, unknown or other
  misc_feature (430)..(430): n is a, c, g, or t
  modified_base (463)..(463): a, c, t, g, unknown or other
  misc_feature (463)..(463): n is a, c, g, or t
tcagacatacgcgtcacgaccggtgctcgatttagctgcgtcacgatctctcttgggggagagaggagccccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctgacactctcctgtgagctctggagtctacagtcagcagacatagccatagtaggttgggttccggtccacggcgtccgacggggaaggggttaggccgaggtgggtcggtcggggtggtagtaggngtagtgtggccaccacgactaccgcngactaccgngtaggggccggcctctacnctacncctccgaagagaccggtattacccgaaaacacngttagaatcctgacaaattagacacgcctgacgccggcggacggacttacccaaaccggttcctctttaccttggacgaaccggaaaactacccccttattttaggtttttaccgggggcccgcccgggaacccgtacgtaccggtcgggggaccacgggggtaccccc

SEQ ID NO: 356899 - DNA, 545 bp, Homo sapiens
  misc_feature: GZ8MTXP02FYV16.22.36.D03.1.454.CMB.2.raw
  modified_base (223)..(223): a, c, t, g, unknown or other
  misc_feature (223)..(223): n is a, c, g, or t
  modified_base (256)..(256): a, c, t, g, unknown or other
  misc_feature (256)..(256): n is a, c, g, or t
  modified_base (426)..(426): a, c, t, g, unknown or other
  misc_feature (426)..(426): n is a, c, g, or t
  modified_base (441)..(441): a, c, t, g, unknown or other
  misc_feature (441)..(441): n is a, c, g, or t
tcagacatacgcgtcacgaccggtgctcgatttagctgcgtcacgatctctcttggggttttgggggggtccctgacactctcctgtgcagcctctggattcacagtcagcagcaatgccatgagttgggtccgccaggctccgaggggaaggggttgcaggtgggtctcggggattgggaagtgatggtgccacacactacgcagactccggtgaggggccncttcatcatctccagagacgattaccgaaaacncagtgaatctgcaaatgtacagcctcagcgccgaggacacggccgtctacttctgtgacgaaagcctcttagtttttcgggccgcggccgacctacgtcggggccacgggcacccgtgtccaccgtctcttcacgcctccaccgacggcccagtcgtcctcccctggccnccctgctccgaggcnccaccgtcgagcgcacgagcccgccgtggctcgccgtgacaggtacctacttccgacgtccgtatcgtccgtggacggtcgggcgtcgggacacggcgacagag

SEQ ID NO: 356900 - DNA, 615 bp, Homo sapiens
  misc_feature: GZ8MTXP02HWGKC.22.36.D03.1.454.CMB.2.raw
  modified_base (330)..(330): a, c, t, g, unknown or other
  misc_feature (330)..(330): n is a, c, g, or t
  modified_base (340)..(340): a, c, t, g, unknown or other
  misc_feature (340)..(340): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggacaaaccccccaactcatcattatgtgtcactcgtccggccctcaggagtntccccccctnactcgtcttctcacgtcctcctaacgtcgtcgaccaacgacccgtaccctacccctaaaccactcctcgtcggtcctccgtagttacgacggtaacgtacgttacttaacttattactacgtacttaacgtttaactttaaagttacggtcgacctaccttcgttcggtttcggtttcggcggtacggaccgaacggtacgtcgtacccgttccgtcggtaccgacgacccgaacggtcctccggtcccccgtccggtaccctaccgttcctccg

SEQ ID NO: 356901 - DNA, 587 bp, Homo sapiens
  misc_feature: GZ8MTXP02GYVRJ.22.36.D03.1.454.CMB.2.raw
  modified_base (309)..(309): a, c, t, g, unknown or other
  misc_feature (309)..(309): n is a, c, g, or t
  modified_base (313)..(313): a, c, t, g, unknown or other
  misc_feature (313)..(313): n is a, c, g, or t
  modified_base (328)..(328): a, c, t, g, unknown or other
  misc_feature (328)..(328): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaaccaacagtgactattgggtcttttgactctgtctcctggtaccaacaaccacccacgaccaaaccccccatcatcatttanggtntcactcgtcgccctnaggacgtctcctcatcgtcttcncnggctcagtctgacacacgccctacccacactctctggctaccgagttcgacggacgacgttacgttactttacttactcgtacttacgtttacctttaaagtacgtccgtacctacttcgtccggtttcggttttccgggcgtacggtacgaccggtaacgtacgtaccggtccgtaccggttccgacgaaccgtaaccggcgtccgtaccccgttcccgtccgtaccttcccg

SEQ ID NO: 356902 - DNA, 515 bp, Homo sapiens
  misc_feature: GZ8MTXP02IHRUF.22.36.D03.1.454.CMB.2.raw
  modified_base (379)..(379): a, c, t, g, unknown or other
  misc_feature (379)..(379): n is a, c, g, or t
  modified_base (511)..(511): a, c, t, g, unknown or other
  misc_feature (511)..(511): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggccaaacccccccaatcatcatttatggtgtcactcgtcggcccctcaggagtctcctcatcgcttctcagctcaagtctgcacacgcctcctacatcnctggctcagtttgagacgagtctacttattactgactagtttcctttaaaatgacgctactctgttggtttcggcggtacgcgaccgtaagtcgaccgtcgtcggtcagcccgaaggctcgcccctcggtcnctcc

SEQ ID NO: 356903 - DNA, 575 bp, Homo sapiens
  misc_feature: GZ8MTXP02JPOXP.22.36.D03.1.454.CMB.2.raw
  modified_base (319)..(319): a, c, t, g, unknown or other
  misc_feature (319)..(319): n is a, c, g, or t
  modified_base (339)..(339): a, c, t, g, unknown or other
  misc_feature (339)..(339): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacacacccagccaaaccccccatcatcattatgtgtcactcgtcgccctnaggatctcctcatcgcttcncagctcaagtctggccaacgccgccctaccctaaccatcctcgtcgggccttaccagtttcgaggtacagttcttacttattactgcttagtttaccttaaattacgccgtacctacttcgtcgtttgggtttccgacgggtacggccgaaccggtacggtcgtaacccggttcccgtaccggttccaaccgcccgtaaacggcctaccggccccctcgggtaccaccgtttcccg

SEQ ID NO: 356904 - DNA, 694 bp, Homo sapiens
  misc_feature: GZ8MTXP02HSF7A.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatgccatgagttggccgcaggctccgaggggtaaggggttgcgaggtggggtctcggggattgggaagtggagtgggtcgacccacacaccgtacgcgaagacctcccggtaggacggggggcccctctttacacttccaacttctacccgagaacgtaacgaactttacccggaaaaacacgaagttacgaaaattccgttacgaactaaagttaggtaaccaacggaccctacgacggaccgacccggaacggtaacccgaaccggggtccccttaccgtaaccgttttcccgtaggttacggaaccgtaaaacggtacccctttaccgttttaaaggttttccgggggacccggtaccgggtaccccggaaccgtttaacccggtcgggggtaccccgtaaaccggggg

SEQ ID NO: 356905 - DNA, 609 bp, Homo sapiens
  misc_feature: GZ8MTXP02JMRHD.22.36.D03.1.454.CMB.2.raw
  modified_base (302)..(302): a, c, t, g, unknown or other
  misc_feature (302)..(302): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctggtaccacaacacccagccaacccccactcatcattatgtntcactcgtcggccctcaggacgtctcctcactcgcttctcaggtcctaccgaagtctaggcaaacaccggccctaccctaaccacttcctcgtgggtcctcctacggtttgacggtaacgacgtccttaacttacttaactcggtccttaacggtttacccttttaaaagttacggccgacctacgtccttcggtttcgggttttcggacgggtacggacctaccggaaacggttcggaacccgttccgtccggttcacggcccgtaacggtcctaccggcccccttcgggtccctaccgtttcccg

SEQ ID NO: 356906 - DNA, 555 bp, Homo sapiens
  misc_feature: GZ8MTXP02I3I9I.22.36.D03.1.454.CMB.2.raw
  modified_base (394)..(394): a, c, t, g, unknown or other
  misc_feature (394)..(394): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccgggggggtccctgacactctcctgtgcagcctctggattcacagtcagcagcaatgccatgagttgggtccgccaggctccgaggggaaggggttgcgaggtgggtctcggggattggaagtgagtggtgccacacactacgcagactccggtgagggggccncgttcatcatctccagagacgacttaccgaaaacacagtagaatctagacaaatgtacagcctcagcgaccgaggacgacggccgtacgtacttcgtgtcgacgaaacgacctcttacgttttcgggcccgtcggaccgacgtacgtcggggccgacgggg

SEQ ID NO: 356907 - DNA, 557 bp, Homo sapiens
  misc_feature: GZ8MTXP02H0Y6R.22.36.D03.1.454.CMB.2.raw
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (330)..(330): a, c, t, g, unknown or other
  misc_feature (330)..(330): n is a, c, g, or t
  modified_base (345)..(345): a, c, t, g, unknown or other
  misc_feature (345)..(345): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaanagtgacagtttggtcttttgactctgtctcctgtaccaacaaccaccacgacccaaaccccccatcatcattangtntcactcgtcgccctcgaggntctctcatcgcttcncagctcaagtctgaccacgccgtccctaccctaaccatcctacgtcggccttaccgtagtttggaacggaccgtagttacttaacgtttatctacgtacttacgtttaccttaaagtcgactcctactcgttcggttcggtttacggcggtacgcgtacgacgtcgaccgttcgacgtcgacgccgaagcctccgacccgtcgtccactccg

SEQ ID NO: 356908 - DNA, 608 bp, Homo sapiens
  misc_feature: GZ8MTXP02HOZ3R.22.36.D03.1.454.CMB.2.raw
  modified_base (303)..(303): a, c, t, g, unknown or other
  misc_feature (303)..(303): n is a, c, g, or t
  modified_base (319)..(319): a, c, t, g, unknown or other
  misc_feature (319)..(319): n is a, c, g, or t
  modified_base (401)..(401): a, c, t, g, unknown or other
  misc_feature (401)..(401): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggcttgggtacgaggccggggggtcctgacactctcctgtgcagcctctggattcacagtcagcagcaatgccatgagttggccncagctcgagggaggtncgaggtggtcgtcggggattgggaaagtggagtggtcgaccaacacaacgtacgcgaacgacctccggtggacgggggcccnctttacgaattcaacttccaccgaaggagaaccgaacttaacccggaaaacacagtagaaatctagactaaatcgtaacacgtccacgacggcgaccggacgaccgacggtacccgtctaacgtttcgacgttacgacgtaaaacgcccgttacgttaggttttccgggcccgaccggtccgaacgttccggcggggacccgacggg

SEQ ID NO: 356909 - DNA, 595 bp, Homo sapiens
  misc_feature: GZ8MTXP02IW3RA.22.36.D03.1.454.CMB.2.raw
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (328)..(328): a, c, t, g, unknown or other
  misc_feature (328)..(328): n is a, c, g, or t
  modified_base (344)..(344): a, c, t, g, unknown or other
  misc_feature (344)..(344): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacagtgactagttggtctttgactctgtctcctgtaccaacaaccaccacgacccaaacccccatcatcatttangtntcactcgtcgcctgaggntctcctcatcgcttcncacgctaccgaagtctgacacgaccgccctaccctaacactctcgtcggcctcgtagttgacggtacgtacgtacttaacttacttacgtcgttacgtaacgttttacctttaaaagttcggtcctacctacgttccgttcggttcgggtttcggacggtacggaccgtaaccggtaacgtccgtaccggttccgtacggtccacgaacccgaacggtcctcccgtccccgtcggtacctaccgtttcccg

SEQ ID NO: 356910 - DNA, 593 bp, Homo sapiens
  misc_feature: GZ8MTXP02JGVT5.22.36.D03.1.454.CMB.2.raw
  modified_base (304)..(304): a, c, t, g, unknown or other
  misc_feature (304)..(304): n is a, c, g, or t
  modified_base (396)..(396): a, c, t, g, unknown or other
  misc_feature (396)..(396): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctgacactctcctgtgcagcctctggattcacagtcagcagcaatgccatgagttgggtccncaggctccgaggggaagggttgcgaggtgggtctcggggattgggaagtgatggtgccacacactacgcagacctccggtagacgggggccncttcatcatctccagacgacgacttaccgaaaacacagtcgaaatcgtagacaaagtgtaacacgtcctacacgcgaccgacggaccgaccggccgtaccttaccgttcgtcggtacgacgtaaacgtacccttcgttacgtttttccgggcccgtccgggaccggaccgttaccggtcgggggaccgtaaccgggg

SEQ ID NO: 356911 - DNA, 779 bp, Homo sapiens
  misc_feature: GZ8MTXP02IHXO1.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaatttttaaaaggtgtcaagtgtgcggtgaaggtattggagtcgtgggggagcttggtacaggcccggggggtccctgacactctcctgtgcagcctctggattcacagtcagcagcaatcgccatgaggttgggtcccgccgaggcctaccgaaggggtaagggttgcgtaggtcggggtcgtcggggattggggaaagtgagtgggtcgacccacacaaccgttaccgcgaacgtacctcccgggtaggaccggggggcccctacgtttcgaacttcacttccctacccgaaacggaacgtaaccgaaaccgtttaaaccccggaaaaaacctaaccgtaaagtacgtaaaacttaccgtacggtaaacctaaaagttacgttaaccgaaccgtaccccgtaacgaaccggcccgggaaccccgggaacggggaaccccgtaaacccggggtccccgttaaccgtttacccgtttaccgttacggttaacggaaaccggtaaaaccgtaaaccccgttttacgtttaaaccggtttttccgggggaccccggtcccgggtaccccggtaacccgttaaccgggtttccgggggacccggtaacccggggg

SEQ ID NO: 356912 - DNA, 618 bp, Homo sapiens
  misc_feature: GZ8MTXP02HF3QK.22.36.D03.1.454.CMB.2.raw
  modified_base (303)..(303): a, c, t, g, unknown or other
  misc_feature (303)..(303): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctgacactctcctgtgcagcctctggattcacagtcagcagcaatgccatgagttgggccncaggctccgaggggaaggggttgcgaggtgggtcgtcggggattgggaagtgacgtggtcgccacacactacgcagaccgtccgtggacggggccgcttcatcactctccagacgacgacttaccgaaaacacagtgaaatctagactaaaagtcgtaacagccctacgacgccggccggaaggaccgaccgggccccggttactacccgttcgttcggtacgaccggaaaacgtcccgttacgtttaaacggtttttccggggcccggtaccgggtacccgtaaccgtaccggttcgggggacccaaccggggg

SEQ ID NO: 356913 - DNA, 537 bp, Homo sapiens
  misc_feature: GZ8MTXP02GXK5M.22.36.D03.1.454.CMB.2.raw
  modified_base (306)..(306): a, c, t, g, unknown or other
  misc_feature (306)..(306): n is a, c, g, or t
  modified_base (358)..(358): a, c, t, g, unknown or other
  misc_feature (358)..(358): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttggccncaggctccgagggagggttgcagtgggtctcggggattggaagtgatgggtnccacgacactacgcagactccgtgaggggccgcttcatcatctccagacgacgacttaccgaaaactacaagtgaatctagacaaatgtacagcctcgacgcgccggacgaccgacggccgtctacgttctacgtcgacgaaagacctcgttacgttttcgggccgtcggaccgtaccg

SEQ ID NO: 356914 - DNA, 635 bp, Homo sapiens
  misc_feature: GZ8MTXP02G2WNY.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtatggagtcgtgggggaggcttgggtacgaggccggggggtccctggacactctcctgtgcagcctctggattcacagtcagcagcaatgccatgagttgggcccgcaggctccgagggaggggttgcgaggtgggtcgtcggggattgggaagtgagtggtgaccacacacgtacgcgacgactccggtagacgggggcctcttcgactcaactctaccgagaacgacgacttacccgaaaacaccagtagaaatcctagaacctaaagtcgtaacgacgacccgtacgacggaccgaccggacgggaaccgaccggacccggttacctaccgttcgtacggttacggaacgtaaaaccgtaccgttaccgttacggttttccggggacccggtaccgggtacccgtaccgtaccggtcggggacccgaaccgggg

SEQ ID NO: 356915 - DNA, 502 bp, Homo sapiens
  misc_feature: GZ8MTXP02IZRHZ.22.36.D03.1.454.CMB.2.raw
  modified_base (360)..(360): a, c, t, g, unknown or other
  misc_feature (360)..(360): n is a, c, g, or t
  modified_base (407)..(407): a, c, t, g, unknown or other
  misc_feature (407)..(407): n is a, c, g, or t
  modified_base (437)..(437): a, c, t, g, unknown or other
  misc_feature (437)..(437): n is a, c, g, or t
  modified_base (482)..(482): a, c, t, g, unknown or other
  misc_feature (482)..(482): n is a, c, g, or t
  modified_base (502)..(502): a, c, t, g, unknown or other
  misc_feature (502)..(502): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgaagactccgtgaggggccgcttcatcatctccagagacgattccgaaaacacagtgaatctgcaaatgtacagcctcagcgccgagacacggccgtctacttctgtgcgaaagaccctctatttttgggccgcggccgactactggggccaggcacctgtcnccgtctcttcacgcctcaccagggcccatccggtctccccctggccnccctgctccaggagcacctccgagagcacngcgcccgtgggctgcctgtcaggtctactcacgcgtatgtctgancggctggcaaggcgcatagn

SEQ ID NO: 356916 - DNA, 593 bp, Homo sapiens
  misc_feature: GZ8MTXP02GYYIW.22.36.D03.1.454.CMB.2.raw
  modified_base (445)..(445): a, c, t, g, unknown or other
  misc_feature (445)..(445): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcagcctctggattcacagtcagcagcaatgccatggagttggccgccaggctccgaggggaggggttgcgaggtgggtcgtcggggatttgggaagtgagtggtgcccacacactacgccaagacctccgggtggacgggggccctcttcgatcatcctccagacgacacttaccgaaaacncaagtagaatctagacaaatgtaaccagcctacgacgccgaccggacggaccgaccggtcccgtacctaccgtttcgacggttcgaacgtaaaacgtacccgttacgtttacggttttcgggaccccggtccgggacccgtaacccgg

SEQ ID NO: 356917 - DNA, 578 bp, Homo sapiens
  misc_feature: GZ8MTXP02ISEMF.22.36.D03.1.454.CMB.2.raw
  modified_base (305)..(305): a, c, t, g, unknown or other
  misc_feature (305)..(305): n is a, c, g, or t
  modified_base (394)..(394): a, c, t, g, unknown or other
  misc_feature (394)..(394): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaaatggcttttgcttgtggctattttaaaaggtgtcaagtgtgcggtgaaggtattggagtctggggggaggcttgggtacaggccgggggggtccctgacactctcctgtgcagcctctggattcacagtcagcagcaatgccatgagttggggtccncaggctccgagggaaggggttgcaggtgggtctcggggattggaaagtgatggtgccacacactacgcagactccggtgagggggcccncgttcatcatctccagagacgacttaccgaaaacacagtgaatctagacaaatgtacacgcctacagcgaccggacggaccgacggcccgtacgtaccttctcgttagaccgtaaacgtaccctctttaacgttttcggggcccgtcgggtccccgacgttaccggtcggggaccgaaccgggg

SEQ ID NO: 356918 - DNA, 523 bp, Homo sapiens
  misc_feature: GZ8MTXP02FIC1P.22.36.D03.1.454.CMB.2.raw
  modified_base (505)..(505): a, c, t, g, unknown or other
  misc_feature (505)..(505): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgcttcatcatctccagagacgattccgaaaacacagtgaatctgcaaatgtacagcctcagcgccgaggacacggccgtctacttctgtgcgaaaagacctcttatttttgggccgtcggccgacctactggggccagggcaccctggtcaccgtctcttcagcctccaccaacgggcccatccggtcttccccgtgccgccctgctccaggacgcacctccgagacgcacagccggccctcggggctcgcctggtcaaggacctactccacgccgtatcgtctgacgngggctggcaggcgcatag

SEQ ID NO: 356919 - DNA, 542 bp, Homo sapiens
  misc_feature: GZ8MTXP02GS5UJ.22.36.D03.1.454.CMB.2.raw
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccgnttcatcatctccagagacgattccgaaaacncagtgaatctgcaaatgtacagcctcagcgccgaggacacggccgtctacttctgtgcgaaagacctctagttttgggccgcggccgactacgtggggccagggcaccctggtccaccgtctccttcacgcctccacccgaaggcccactcggtccttccccctggccgcccctgcctcccgacggacgccaccctccgagacgcacgacgccggcccgtggggcctcgcccgtggtcaaggtactaccttccgacgcgtactcgtcgtgaggcggctcggcaggcgacatag

SEQ ID NO: 356920 - DNA, 605 bp, Homo sapiens
  misc_feature: GZ8MTXP02JACOJ.22.36.D03.1.454.CMB.2.raw
  modified_base (363)..(363): a, c, t, g, unknown or other
  misc_feature (363)..(363): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacacacccagccaaaccccccatcatcatttatgtgtcactcgtcggccctcaggagtctcctcatcgcttctcaggcctccaatctgcaacncgccctccctaacatctctgggcctccgtagtttgacggtacgagtcttacgttattactgtactacgtttacctttaaattacggccgtacctacgttcttccggtttggttttccggcgggtacggtccgtaaccggtaaagtccggtaacccggttcccgtacccggggttcaacccggaaccccgtaaacggggtcccttaccggaccccccgttaccgggtccctaccgtttccccg

SEQ ID NO: 356921 - DNA, 599 bp, Homo sapiens
  misc_feature: GZ8MTXP02H6ENB.22.36.D03.1.454.CMB.2.raw
  modified_base (301)..(301): a, c, t, g, unknown or other
  misc_feature (301)..(301): n is a, c, g, or t
tcagacatacgcgtcacgaccggtgctcgatttagctgcgtcacgatctctcttgggggagagaggagccccagccctgggattttcaggtgttttcatttggtgatcaggactgaacagagagaactcaccatggagtttgggctgaagtggcttttgcttgtggctattttaaaaggtgtcaagtgtgcggtgaagtattggagtcgtgggggaggcttggtacaggccgggggggtccctgacactctcctgtgcagcctctggattcacagtcagcagcaatgccatgagttggccncaggctcgaggggagggttgcgagtggggtctggggattgggaagtggagtgggtcgacccacacaccgtacgcaaggaacctccggtggacgggggcccgcttcactcatcctcagagacgactaccgaaaacacagtagaatctacgactaaatagtacacgcctacgacgcgaccgacggaccgaccggcccgtacgtacgttcgtacgtacgtaacgaaacgtaccttcgtttaacgttttcggggacccgtccgggtacccgtaccgtaccggtacggggacccgaaccgggg

SEQ ID NO: 356922 - DNA, 554 bp, Homo sapiens
  misc_feature: GZ8MTXP02F1KDJ.22.36.D03.1.454.CMB.2.raw
  modified_base (301)..(301): a, c, t, g, unknown or other
  misc_feature (301)..(301): n is a, c, g, or t
  modified_base (393)..(393): a, c, t, g, unknown or other
  misc_feature (393)..(393): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagtgggtccncaggctccgaggggagggttgcaggtgggtctcggggattggggaagtgatgggtcgccacacactacgcagacctccggtgacgggggccncgttcatcatctccagagacgattaccgaaaacacagtgaaatctagacaaatcgtacagcctcacgcgacgagaccgacggccgtctacttctgcgacgaacgtacctcgttacgtttcgggcccgtcggacccgacgtaccggtcggggaccgacgggg

SEQ ID NO: 356923 - DNA, 592 bp, Homo sapiens
  misc_feature: GZ8MTXP02G2VOG.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtatggagtcgtgggggaggcttgggtacgaggccgggggggtccctggacactctcctgtgcagcctctggattcacagtcagcagcaatgccatgagttgggtcccgccgaggctccgaaggggaaggggttacaggtgggtcgtcggggtattagggaagtggagtggtcgccacacacgtacgcacgacgtccgtggacggggccgctttcactcaatctccagacgacgactaccgaaaacacagtgaaatctagacaaatgaacagacctacacggaccgccgaacggaccgacggtaccgtaccgtacttcgtgtacgacgaaaacggtcctacttacggttttcggggcccgcggtacccgactaccggtcggggccgacggacccg

SEQ ID NO: 356924 - DNA, 575 bp, Homo sapiens
  misc_feature: GZ8MTXP02HAAX6.22.36.D03.1.454.CMB.2.raw
  modified_base (217)..(217): a, c, t, g, unknown or other
  misc_feature (217)..(217): n is a, c, g, or t
  modified_base (250)..(250): a, c, t, g, unknown or other
  misc_feature (250)..(250): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattaccgaaaacncagtgaatctgacaaatgtacagcctcagcgccgaggacacggccgtctacttctgtgacgaaagcctcttagttttgggccgcggccgaccgtacgtcggggccagggcacccgtggtccaccgtctctcacgcctccaccgacgggcccacgtccggtccttcccccgtggcccgcccctgccctccgacggacgccacccgtccgacgacgccacgacggcccggcccgtggggcctcggcccgtggtaccgaacgggtaccttaccgttccgacggtccgtagtcgtcgtgacggcgggcgtcggcgaacggcgacgagtg

SEQ ID NO: 356925 - DNA, 581 bp, Homo sapiens
  misc_feature: GZ8MTXP02HVGQR.22.36.D03.1.454.CMB.2.raw
  modified_base (313)..(313): a, c, t, g, unknown or other
  misc_feature (313)..(313): n is a, c, g, or t
  modified_base (374)..(374): a, c, t, g, unknown or other
  misc_feature (374)..(374): n is a, c, g, or t
tcagacatacgcgtcacgaccggtgctcgatttagctgcgtcacgatctctcttggggagctctgagagaggagcccagccctgggattttcaggtgttttcattttggtgatcaggactgaacagagagaactcaccatggagtttgggctgaagtggtcttttgcttgtggctaattttaaaaggtgtcaagtgtgcggtgaaggtattggagtcgtgggggaggcgttggtacgagggcccggggggtccctgacactctcctgtgcaacctctggattcacagtcagcagcaatgccatgagttggccncaggctccgaggggaagggttgcaggtgggtcgtggggattgggaagtgagtggtgccacncgtactacgcacgactccggtgacggggccgtctcatcatctcagagacgataccgaaaactacagtagaatctagacaaattagaacaacgccacaacgccgaccgacggacgaccggaccgtccgtaactttccgtagtacgacgaaacgtaacccgttacttaacggtttttcgggcccggtccggacccgtacgttaccgggg

SEQ ID NO: 356926 - DNA, 531 bp, Homo sapiens
  misc_feature: GZ8MTXP02IU4ET.22.36.D03.1.454.CMB.2.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (304)..(304): a, c, t, g, unknown or other
  misc_feature (304)..(304): n is a, c, g, or t
  modified_base (359)..(359): a, c, t, g, unknown or other
  misc_feature (359)..(359): n is a, c, g, or t
  modified_base (387)..(387): a, c, t, g, unknown or other
  misc_feature (387)..(387): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacngtgacattgggtctttgactctgtctctgtaccaacaacaccaggccaacccccactcatcatttatggtntcactcgtcgccctcaggagtctcctcatcgcttctcagctccaagtctgcaacncggccctccctaacactctctcggctcngtttgaggacgagtctacttattactgtctagtttacctttaaattacggcgcctacttcttcggttaggttttcggcggtacggcgaccgacgtcgtaccgtcgtcgtcacgccgacggctcgccccgtcggtccacgttccg

SEQ ID NO: 356927 - DNA, 546 bp, Homo sapiens
  misc_feature: GZ8MTXP02HOD04.22.36.D03.1.454.CMB.2.raw
  modified_base (247)..(247): a, c, t, g, unknown or other
  misc_feature (247)..(247): n is a, c, g, or t
  modified_base (416)..(416): a, c, t, g, unknown or other
  misc_feature (416)..(416): n is a, c, g, or t
  modified_base (526)..(526): a, c, t, g, unknown or other
  misc_feature (526)..(526): n is a, c, g, or t
  modified_base (545)..(545): a, c, t, g, unknown or other
  misc_feature (545)..(545): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttggtccgccaggctccagggaagggttgcagtgggtctcggggattggaagtgatgggtgccacacactacgcagactccgtgagggccgcttcatcatctccagagacgattccgaaaacncagtgaatctgacaaatgtacagcctcagcgccgaggacacggccgtctacttctgtgacgaaaagaccttctagtttttgggccgcggtccgacctacgtggggcacgggcaccgtggtccaccgtctcttcagcctccaccacggcccagtccgcctccccgtgccnccctgctcccgagacgcacccgtcgagacgccacgagccggccctggggcctgcccttcggacaacggtacctacttcccgaacgcggtaactcgtctgacggccggtcncgggcaacggccacgaagng

SEQ ID NO: 356928 - DNA, 730 bp, Homo sapiens
  misc_feature: GZ8MTXP02HO1O0.22.36.D03.1.454.CMB.2.raw
tcagacatacgcgtcacgaccggtgctcgatttagctgcgtcacgatctctcttggggagctctgagagaggagcccagccctgggattttcaggttgttttcatttggtgatcaggactgaacagagagaactcaccatggagtttgggctgaagtggcttttgcttgtggctaattttaaaaggtgtcaagtgtgcggtgaaggtattggagtcgtgggggagcgttggtacgagggccggggggtccctgacactctcctgtgcagcctcgtggacttcacagtcagcagacaatcgccagtggtaggtttcggggtcccgccgacggccgtaccggagggggtaacggggttgaccggtaggggttcggggtccggtacgggggtagtttacggggaaagttggaaggttgggtaccggacccaccgaaccgtaacgtaccgaccgtaacggtaccgttcccggggtacgggaccgggggtccctaccgtttacgaacttcccgtaacttcccgtacccgaaggaaccgtaaccgtaacgttaaaccccgaaaaacgtacgtaaggtaacgtaaacttcgtaacgaaacctaaaagtcggtaaccaacggtccctacgacggaccggacccggacggacccgtaccggtcccttacttaccgttcgcggtaacgacgtaaaaccgtccgttacgtttacggttccgggcccgtcggacccgtacgg

SEQ ID NO: 356929 - DNA, 617 bp, Homo sapiens
  misc_feature: GZ8MTXP02FTPZX.22.36.D03.1.454.CMB.2.raw
  modified_base (364)..(364): a, c, t, g, unknown or other
  misc_feature (364)..(364): n is a, c, g, or t
  modified_base (399)..(399): a, c, t, g, unknown or other
  misc_feature (399)..(399): n is a, c, g, or t
  modified_base (437)..(437): a, c, t, g, unknown or other
  misc_feature (437)..(437): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccgggggggtccctgacactctcctgtgcagcctctggattcacagtcagcagcaatgccatgagttgggtccgccaggctccgaggggaaggggttgcgaggtgggtcgtcggggattgggaagtgagtgggtnccacacactacgcagacctccggtgacgggggccncttcatcatctccagagacgacttaccgaaaacacagngaaatctagacaaatgtacacgccctacgacgccgaccgaacggaccgaaccgggcccgttactaccgtttcgtacggttacgaccggtaaaacgtacccttacgtttaacggtttttccggggacccggtaccgggtaccccggtaccgttaccggtacgggggacccgtaaccggggg

SEQ ID NO: 356930 - DNA, 698 bp, Homo sapiens
  misc_feature: GZ8MTXP02H4G8V.22.36.D03.1.454.CMB.2.raw
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (300)..(300): a, c, t, g, unknown or other
  misc_feature (300)..(300): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctgatcatctggacagtcgatcagctatttccngcacgtgggaccaangtgactagttggtctttgactctgtctcctgtaccaactacaccagacccaaaccccatcatcattangctcactcgtcgcctcgagctctcctcactcgcttctcgacggtcctaccgaaagttcccgtagggacccaaaccgacccggtccccttaccccctaaacccacttcccgtaccgttacgggcccttacccgtaggtttcggaacgggtaccgtacgttactacgttttaacttacgtacgttaccttaacgtttacctttaaagttacggtaccgtacccttaaccgttcgttaccgggtttagggttttccgggacgggttacggtacccgtaaccggttaacggtaccggtaaccccggttcccgttcccggggttaccaaccggttaaccccgaaacgggtccccgttacccggtccccccggtttaccggttacccttacccgtttcccccgg

SEQ ID NO: 356931 - DNA, 625 bp, Homo sapiens
  misc_feature: GZ8MTXP02G50FD.22.36.D03.1.454.CMB.2.raw
  modified_base (303)..(303): a, c, t, g, unknown or other
  misc_feature (303)..(303): n is a, c, g, or t
  modified_base (318)..(318): a, c, t, g, unknown or other
  misc_feature (318)..(318): n is a, c, g, or t
  modified_base (321)..(321): a, c, t, g, unknown or other
  misc_feature (321)..(321): n is a, c, g, or t
  modified_base (324)..(324): a, c, t, g, unknown or other
  misc_feature (324)..(324): n is a, c, g, or t
  modified_base (337)..(337): a, c, t, g, unknown or other
  misc_feature (337)..(337): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacagtgacattgggtctttgactctgtctctgtaccaacacaccagaccaaacccccatcatcattatgtntcactcgtcgccctnagntcncctcatcgcttcncacggctaccaagtcgtgaccaacgaccggccctaccctaacctactcctcgtcgggccttacgtacgtttgaggtacgtagttaccttaacttattactacgtcttaacgtttacctttaaagtacggccgtacctacgttcgttcggtttcgggttttacggcgggttaacggccgtaaccggtacggttaccgtaccccggttccgttacccggtaccgaacccggcccgtaaacgggtcccgtcccggtaccccccgtttcgggtaccctaacccgtttccccg

SEQ ID NO: 356932 - DNA, 762 bp, Homo sapiens
  misc_feature: GZ8MTXP02HX2QZ.22.36.D03.1.454.CMB.2.raw
  modified_base (306)..(306): a, c, t, g, unknown or other
  misc_feature (306)..(306): n is a, c, g, or t
  modified_base (324)..(324): a, c, t, g, unknown or other
  misc_feature (324)..(324): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggaccaaaccccccatcatcatttangtgtcactcgtcgccctnaggagtctcctcatcgcttctcacggcctcaagtcctggaccaacgaccggtccctaccctaaacccacttcctccgtcggggtaccttcccgtaacggtttttcggaacgggtaaccgtacgttacctttaaaccttttacgtttaaaccttggttacccttaaacgggttttttacccttttaaaaaacgtttacgggtacccggttacccctaaaccgtttccgtttaccggggtttacgggggtttttttaccggggccgggggttaaaccggggtacccgttaaaccccggggttaaaacggttccgggtaaacccccgggtttcccgttacccgggggtttacccgaaacccgggttaacccccgaaaacggggttcccgttaccccggtacccccccgtttccggggttacccttaacccgtttcccccgg

SEQ ID NO: 356933 - DNA, 683 bp, Homo sapiens
  misc_feature: GZ8MTXP02JUSX1.22.36.D03.1.454.CMB.2.raw
  modified_base (327)..(327): a, c, t, g, unknown or other
  misc_feature (327)..(327): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacgaggccgggggggtccctgacactctcctgtgcagcctcgtggattcacagtcagcagcaatgccagtgagttcggccgcaggctccgagggaggggttncgaggtgggtcgtcggggattgggaagtgagtggtcgcctaacacactacgcacgtaccgtccggtggacgggggtccctcttacacgtccacgtcctacccgagaacgtacgaacgttaaccccggaaaaactaccgaagttacgaaacttcgtaacggtaaccaaagtcgtaacgaacgtccctacgacgacccggaccggaacggaccgtacccgggtaccttaccgttaccgtttacggtcggtaaccggtaaccggtaaaaccgtcccgtttaccgtttaaggttttcccgggggccccgtacccggggtccccgtaacgtcccgggtccgggggacccgtaacccggggg

SEQ ID NO: 356934 - DNA, 504 bp, Homo sapiens
  misc_feature: GZ8MTXP02IDG6O.22.36.D03.1.454.CMB.2.raw
  modified_base (218)..(218): a, c, t, g, unknown or other
  misc_feature (218)..(218): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (321)..(321): a, c, t, g, unknown or other
  misc_feature (321)..(321): n is a, c, g, or t
  modified_base (342)..(342): a, c, t, g, unknown or other
  misc_feature (342)..(342): n is a, c, g, or t
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
  modified_base (429)..(429): a, c, t, g, unknown or other
  misc_feature (429)..(429): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctctggtaccaacacaccaggccaaaccccccatcatcatttangtntcactcgtcggccctnaggagtctcctcatcgcttcncagctcagtctgcaancgcctccctacatcnctggctccagtttgaggacgagtctacttattactgctacgttctttaaatcggcnccgtactctcgttaggtttcgcggtacggcacgagtcgacgtccgcgtcagccaagctacgccctcggtcacgtc

SEQ ID NO: 356935 - DNA, 531 bp, Homo sapiens
  misc_feature: GZ8MTXP02FX9VZ.22.36.D03.1.454.CMB.2.raw
  modified_base (250)..(250): a, c, t, g, unknown or other
  misc_feature (250)..(250): n is a, c, g, or t
  modified_base (327)..(327): a, c, t, g, unknown or other
  misc_feature (327)..(327): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaggtgtcaagtgtgcggtgaaggtattggagtcgtgggggagcttggtacaggccggggggtccctgacnctctcctgtgcagcctctggattcacagtcagcagcaatgccatgagttggtccgccaggctccgaggggagggttncgagtggctcggggattggagtgagtggtgccacgacactacgcagacgtccgtgacggggccgcgttcatcatctccagagacgatacgaaaacacagtagaatctagacaaatgtacacgcctcgagcgccgacggacgaccggccgtcgtactctgcgacgaacgtccttacgttacgtttcgggaccgtcggaccgtacg

SEQ ID NO: 356936 - DNA, 537 bp, Homo sapiens
  misc_feature: GZ8MTXP02FK68Q.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttgggtacaggccgggggggtccctgacactctcctgtgcagcctctggattcacagtcagcagcaatgccatgagttgggtccgccaggctccgaggggaaggggttgcgaggtggggtcgtcggggattgggaagtgatgggtgccacacactacgcagactccgtgaggggccgcttcatcatctccagagacgattaccgaaaacacagtgaaatctagacaaatgtaacagccctgagcgccgaggacacgcgtctactctgtcacgaacgaccgtcttagtttggccgcggccgacgtacgtcggggcacggg

SEQ ID NO: 356937 - DNA, 553 bp, Homo sapiens
  misc_feature: GZ8MTXP02FOUCU.22.36.D03.1.454.CMB.2.raw
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccagcaaacccccccactcatcatttatggtgtcactcgtcggccctcaggagtctctccatcgcttctcaggctccaagtctgacaacacgcctccctaaccatctctgggctcccagtttgaggacgagtctactttattactgtctagtttacctttaaaagttaggtccgtaccacttcttcgttgggttttccggcggtaggccaccggaaagtcgacccgttcctcggtacacgcccaaaggcctcgccccctcggtaccacgtctttcccg

SEQ ID NO: 356938 - DNA, 563 bp, Homo sapiens
  misc_feature: GZ8MTXP02ICWRL.22.36.D03.1.454.CMB.2.raw
  modified_base (309)..(309): a, c, t, g, unknown or other
  misc_feature (309)..(309): n is a, c, g, or t
  modified_base (399)..(399): a, c, t, g, unknown or other
  misc_feature (399)..(399): n is a, c, g, or t
  modified_base (433)..(433): a, c, t, g, unknown or other
  misc_feature (433)..(433): n is a, c, g, or t
  modified_base (478)..(478): a, c, t, g, unknown or other
  misc_feature (478)..(478): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctggacactctcctgtgcagcctctggattcacagtcagcagcaatgccatgagttggccncaggctccgaggggaaggggttgcaggtgggtcgtcggggagttggaagtgagtggtgccacgacactacgcagactcgtgacggggccncgttcagtcatctccagagacgataccgaaaacncagtgaatctgacaaatgtacagcctacagcgaccgacggaaccncgggtacccttactacgttcgtacgttacgacgaaaacggtccctacgtttacgttttcggggccccgtcggtaccccgtaacgg

SEQ ID NO: 356939 - DNA, 593 bp, Homo sapiens
  misc_feature: GZ8MTXP02GXCX2.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctatcttaaaaggtgtcaagtgtgcggtgaaggtattggagtcgtgggggagcttggtacaggccggggggtccctgacactctcctgttcagcctctggattcacagtcagcagcaatcgccatgagttcgggtcccgccaggctccgaggggtaaggggttgcgaggtgggtcgtcggggattgggaagtgagtggtgccacacactacgcagactccggtaggacggggccgcgttcactcactctccagacgacgacttaaccgaaaacacgaagtagaatctagacaaagtagtaacacgcctacacgccgaccggacggaccgaccggacccgtaccttaaccgttccgtacgttacgaacgtaaacgtacccgttacgttaacgttttccggggcccgtccgggaccgtaaccgg

SEQ ID NO: 356940 - DNA, 621 bp, Homo sapiens
  misc_feature: GZ8MTXP02JE4VK.22.36.D03.1.454.CMB.2.raw
  modified_base (219)..(219): a, c, t, g, unknown or other
  misc_feature (219)..(219): n is a, c, g, or t
  modified_base (319)..(319): a, c, t, g, unknown or other
  misc_feature (319)..(319): n is a, c, g, or t
  modified_base (342)..(342): a, c, t, g, unknown or other
  misc_feature (342)..(342): n is a, c, g, or t
  modified_base (359)..(359): a, c, t, g, unknown or other
  misc_feature (359)..(359): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggacccaacagtgactagttgggttcttttgactctgtctccgtaggtaccaacaaccacccgaggaccccaaaccccccatcatctatttanggcgtcactcgtcggccctgagntctcctcatcgtcttcncagctcaagtctgacaacgccgtccctaccctaacactcctcgtcgggtcctccgtaggtttgacgggtacgagttctactttattactcgtacttagtttacctttaaaagtcggaccgcctacgttcgttacggtttcgggtttcggacggtacggcgaaaccggtacggtccgacccggttccgtaccgggtaccaccggaaccccgtaacggggtcccttaccccgggcccccgttacgggtccctacctttccccgg

SEQ ID NO: 356941 - DNA, 579 bp, Homo sapiens
  misc_feature: GZ8MTXP02HP4CZ.22.36.D03.1.454.CMB.2.raw
  modified_base (198)..(198): a, c, t, g, unknown or other
  misc_feature (198)..(198): n is a, c, g, or t
  modified_base (310)..(310): a, c, t, g, unknown or other
  misc_feature (310)..(310): n is a, c, g, or t
  modified_base (397)..(397): a, c, t, g, unknown or other
  misc_feature (397)..(397): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttaattttaaaaggtgtcaagtgtgnggtgaaggtattggagtcgtgggggaggcgttggtacaggcccggggggtccctgacactctcctgttcagcctctggattcacagtcagcagcaatgccatgagttggccncaggctcgagggaggggttgaggtgggtcgtcggggattggaagtgagtggtcgcacacactacgcagacctcgtggacggggcccncgttcatcaacgtctcccagacgacgacttaccgaaaacacagtagaatctagacaaatgtaacacgcctcgaacgccgaccgtaaggacctaccgggccgttctaaccttcgtacgtgacgtaaaacgtccttaacgtttaagttttccgggccgccggtacccgacgttacggccggggg

SEQ ID NO: 356942 - DNA, 634 bp, Homo sapiens
  misc_feature: GZ8MTXP02JA6CD.22.36.D03.1.454.CMB.2.raw
  modified_base (328)..(328): a, c, t, g, unknown or other
  misc_feature (328)..(328): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctgtaccaacaaccacccacggaccaaaccccccaactcactcatttatggtgtcactcgtcgccctnagagtctcctcatcgcttctcagcctccaagtctcggcaacacggccctaccctaacactctctcgggctccgtagtttgaggacgtagtctacttattactgtactacgtttacctttaaaagtcgccgtacctacgttccgttcggtttcgggttttccgggacggtacggtaccgtaaaccggtaaacggtcggtaaccccggtttacccgttccgggtaccgtaaccggtaacccccgtaaaacgggtcccgttaccccgggtacccccccgtttcgggttacccctaacccgtttcccccg

SEQ ID NO: 356943 - DNA, 561 bp, Homo sapiens
  misc_feature: GZ8MTXP02JHNKX.22.36.D03.1.454.CMB.2.raw
  modified_base (306)..(306): a, c, t, g, unknown or other
  misc_feature (306)..(306): n is a, c, g, or t
  modified_base (392)..(392): a, c, t, g, unknown or other
  misc_feature (392)..(392): n is a, c, g, or t
  modified_base (411)..(411): a, c, t, g, unknown or other
  misc_feature (411)..(411): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaggtgtcaagtgtgcggtgaaggtattggagtcgtgggggaggcttggtacaggccggggggtccctgaccactctcctgtgcagcctctggattcacagtcagcagcaatgccatgagttggccnccaggctccgaggggagggttgcgaggtgggtcgtcggggatttggggaagtgagtgggtcgccacacactacgcagactccgggnggacggggccgctcgatcntctccagagacgactacgaaaacacagtagatcagacaatgtacacgcctcgacgcgaccggacggaccgacggcccggtacttacgttccgtagtcgacgaaacggtacctacgttacggttttcgggcccggtccggaccgtaaccgg

SEQ ID NO: 356944 - DNA, 519 bp, Homo sapiens
  misc_feature: GZ8MTXP02JK0JI.22.36.D03.1.454.CMB.2.raw
  modified_base (287)..(287): a, c, t, g, unknown or other
  misc_feature (287)..(287): n is a, c, g, or t
  modified_base (464)..(464): a, c, t, g, unknown or other
  misc_feature (464)..(464): n is a, c, g, or t
  modified_base (489)..(489): a, c, t, g, unknown or other
  misc_feature (489)..(489): n is a, c, g, or t
tcagacatacgcgtcacgaccggtgctcgatttagctgcgtcacgatctctcttgggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacacaccaggcaaacccccacncatcattatgtgtcactcgtcggcctcagagtctctccatcgcttctcaggctccaagtctggcaacacggccctccctaaccatcctctcgggctcccgagtttcgaggacgagtctacttattaactgactacgttacctttaaattacggctccactctcgtggttttcggcgnggcaccgagtcgaccgtctcggtcncgccaaggctcgccctcggtcacgtctccg

SEQ ID NO: 356945 - DNA, 576 bp, Homo sapiens
  misc_feature: GZ8MTXP02F5WO4.22.36.D03.1.454.CMB.2.raw
  modified_base (280)..(280): a, c, t, g, unknown or other
  misc_feature (280)..(280): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcgttggtacaggccggggggtccctgacactctcctgtgcagcctctggattcangtcagcagcaatgccatgagttggtccgcaccggctccgaggggaaggggttgcgaggtgggtctcggggattgggaagtgagtggtcgccacacactacgcagactccggtggacggggccgtcttcgactcactctaccagacgacgacttaccgaaaacacagtagaatctagacaaatgtacacgcctcagccgaccggaacggaccgaccggtccgtacgttaccttcgtacggtcgaccgaaacgtacttacgtttacggttttcggggcccgtcgggacccgtaaccgg

SEQ ID NO: 356946 - DNA, 545 bp, Homo sapiens
  misc_feature: GZ8MTXP02GHI5I.22.36.D03.1.454.CMB.2.raw
  modified_base (215)..(215): a, c, t, g, unknown or other
  misc_feature (215)..(215): n is a, c, g, or t
  modified_base (249)..(249): a, c, t, g, unknown or other
  misc_feature (249)..(249): n is a, c, g, or t
  modified_base (449)..(449): a, c, t, g, unknown or other
  misc_feature (449)..(449): n is a, c, g, or t
  modified_base (544)..(544): a, c, t, g, unknown or other
  misc_feature (544)..(544): n is a, c, g, or t
tcagacatacgcgtcacgaccggtgctcgatttagctgcgtcacgatctctcttgggtttgggggggtccctgacactctcctgtgcagcctctggattcacagtcagcagcaatgccatgagttgggtccgccaggctccagggaagggttgcagtgggtctcggggattggaagtgatggtgccacacactacgcagactccgtgaggggccncttcatcatctccagagacgattacccgaaaacncagtgaatctgcaaatgtacagcctcagcgccgaggacacggccgtctacttctgtgacgaaacgacctcttagtttttcgggccgcggccgaccgtacgtcggggccagggccacccgtggtccaccgtctcttcacgccctaccaccgaacgggcccagtccggtccttcccccgtggccgccctgcctccgaaggcncacccgtccgagacgcacgcgccggcctggctcgcctggtacaacggtctacgtccgaacgctatcgtctagcggcggctcggacaaggcacagng

SEQ ID NO: 356947 - DNA, 557 bp, Homo sapiens
  misc_feature: GZ8MTXP02I7CE0.22.36.D03.1.454.CMB.2.raw
  modified_base (345)..(345): a, c, t, g, unknown or other
  misc_feature (345)..(345): n is a, c, g, or t
  modified_base (376)..(376): a, c, t, g, unknown or other
  misc_feature (376)..(376): n is a, c, g, or t
  modified_base (437)..(437): a, c, t, g, unknown or other
  misc_feature (437)..(437): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctgacactctcctgtgcagcctctggattcacagtcagcagcaatgccatgagttgggtccgccgaggctccgaggggaggggtttcgagtgggtcgtcgggngtggaggtgagtggtgccacacactacgacncgactccgtggacggggccgcttcatcactctccagagacgattacccgaaaacacagtanatactgacaaatatacacgacctcagacgccgacggacaccggccgtctacttctgtcgacgaaacgacctacttagttttcgggccgccggaccgacgtacgtcgggaccgacggcccg

SEQ ID NO: 356948 - DNA, 594 bp, Homo sapiens
  misc_feature: GZ8MTXP02G76YS.22.36.D03.1.454.CMB.2.raw
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaagggttgcagtgggtctcggggattggaagtgatggtgccacacactacgcagactccgtgaggggccncttcatcatctccagagacgattccgaaaacncagtgaatctgacaaatgtacagcctcagcgccgaggacacggccgtctacttctgtgacgaaagcctcttagtttttcgggccgcggccgaccgtacgtcggggccagggcacccgtggtccaccgtctccttcacgcctccaccgaacgggcccacgtccgtcccttcccccgtggcccgcccctcgccctccgacggacgccacccgtccgacgacgccacgacgcccggcccgtcggggcctcggccgtcggtcgaaacgggtaccttaccgttcccgacggtccgtactcggtcgtcggtacggccggggacgtcggggacgaacgggccgacgaacgtcg

SEQ ID NO: 356949 - DNA, 569 bp, Homo sapiens
  misc_feature: GZ8MTXP02J0DQL.22.36.D03.1.454.CMB.2.raw
  modified_base (303)..(303): a, c, t, g, unknown or other
  misc_feature (303)..(303): n is a, c, g, or t
  modified_base (401)..(401): a, c, t, g, unknown or other
  misc_feature (401)..(401): n is a, c, g, or t
  modified_base (437)..(437): a, c, t, g, unknown or other
  misc_feature (437)..(437): n is a, c, g, or t
  modified_base (500)..(500): a, c, t, g, unknown or other
  misc_feature (500)..(500): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccgggggggtccctgacactctcctgtgcagcctctggattcacagtcagcagcaatgccatgagtttgggtccnccaggctccgaggggaaggggttgcgaggtgggtctcggggattgggaagtggagtggtgccacgacactacggcagacctccggtagagggggcccncgttcatcatctaccagagacgattacccgaaaacncagtagaaatctgacaaatgtacacgcctacagccgaccgaggaccacggccgtctacttccnggtcgacgtaaacgccttacgtttagtttcggggccgtcggccgtacctacggtcgggggaccacgggg

SEQ ID NO: 356950 - DNA, 533 bp, Homo sapiens
  misc_feature: GZ8MTXP02IN6LF.22.36.D03.1.454.CMB.2.raw
  modified_base (366)..(366): a, c, t, g, unknown or other
  misc_feature (366)..(366): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaggtgtcaagtgtgcggtgaaggtattggagtctgggggaggcttggtacgaggccggggggtccctgacactctcctgtgcagcctctggattcacagtcagcagcaatgccatgagttggccgccaggctccgaggggaggggttgcgagtgggtctcggggatttgggaagtgatggtcgccncgacactacgcagactccggtgaggggccgcgttcatcatctccagagacgataccgaaaacacagtagatctgacaaatgtacagctcagcgcgacgacacggccgtctacttcgtacgtcgacgaaagtacctacgttacgttttcgggccgtcggaccgtacgg

SEQ ID NO: 356951 - DNA, 615 bp, Homo sapiens
  misc_feature: GZ8MTXP02HKG26.22.36.D03.1.454.CMB.2.raw
  modified_base (251)..(251): a, c, t, g, unknown or other
  misc_feature (251)..(251): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcaggtgggtctcggggattggaagtgatggtgccacacactacgcagactccgtgaggggccgcttcatcatctccagagacgattaccgaaaacncagtgaatctgcaaatgtacagcctcagcgccgaggacacggccgtctactctgtgacgaagacctcttagtttttcgggccgcggccgaccgtacgtggggaccagggccacccgtggtccaccgtctctcacgtcctaccaccgaacgggcccacgttccggtcccttcccccgtcggcccgtccccgtcgccccgttacccgacggacgacccgacccgttacccgacggacgaccgacgacggcccggcccgtcgggccgtcggccgtacgggtcgaaacgggtcctaccgttcccaccggtacgttactcggttcgtacggcggccgggcggtcggaccgaaggccgccgtaacggtcg

SEQ ID NO: 356952 - DNA, 608 bp, Homo sapiens
  misc_feature: GZ8MTXP02GAP3O.22.36.D03.1.454.CMB.2.raw
  modified_base (305)..(305): a, c, t, g, unknown or other
  misc_feature (305)..(305): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgtggtgaaggtattggagtcgtgggggaggcttggtacgaggccggggggtccctgacactctcctgtgcagcctcgtggattcacagtcagcagcaatgccatgagttgggccncgaggctcgagggagggttgcaggtgggtcgtcggggattgggaagtggagtgggtcaccacacacgtacgccagaccgtccggtgggacgggggccctcttcacgtcactctccagacgacgacttaccgaaaacacacgtagaaactcgtagactaaagtcgtaacacgccctacgacgccggaccggacggaccgaccggtcccgtacttaccgttcgtacggtacgacgtaaacgtaccttacgtttaggtttccgggcccggtccggtaccggacgtaccggtcggggcccgtacggg

SEQ ID NO: 356953 - DNA, 641 bp, Homo sapiens
  misc_feature: GZ8MTXP02G3WXG.22.36.D03.1.454.CMB.2.raw
  modified_base (233)..(233): a, c, t, g, unknown or other
  misc_feature (233)..(233): n is a, c, g, or t
  modified_base (297)..(297): a, c, t, g, unknown or other
  misc_feature (297)..(297): n is a, c, g, or t
  modified_base (343)..(343): a, c, t, g, unknown or other
  misc_feature (343)..(343): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacngtgacattgggtctttgactctgtctctggtaccaacaacacccgacgaaccccaaaccccacncactactatttagtgtctcacgtcggtccgcctagagtcgtctccnctacgtctcttcctacgcgtcctacgactcgtacgaccaaccgccgtccctaaccctatacctctacggtcgtccctacgttacggttacggaacggtacgtacttacgttaactttacgttactcgtacgttaccgttttaacgtttaaagtaccggtcctacctcgttcgttcgggtttcggggttcggacgggttacgacccgtaacggtacggttaccggacccgtttccggtccggtacgacccgaaccggtacgtccgtaccccgtccccggtacgtccctactttccccgg

SEQ ID NO: 356954 - DNA, 708 bp, Homo sapiens
  misc_feature: GZ8MTXP02GDKAB.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttgggtacgaggccgggggggtccctgacactctcctgtgcagcctctggattcacagtcagcagcaatgccagtgaggtttcgggtcccgccgagggcctccggaaggggtaaggggttgcgtagggtcggggtcgtcgggggatttgggaagtggagtggtcgccacacactacgcagaccctccggtgacgggggccctcgttacacgttcacttcctaccgaagaacggtaaccgtaacttaacccgaaaaacacgaagtacgaaacttccgtaagactaaaatcgtaaacacggcccctacgaacggcccggaaccggaacgggacccgaaccggggtccccgttaacgttacccgtttcgtacggtacggtaaccgaaaaaccggttcccgttaccgttttaacgggtttttccgggggcccccggtaccgggtaccccggtaaccgttaaccgggtccgggggtacccgtaaccccggggg

SEQ ID NO: 356955 - DNA, 567 bp, Homo sapiens
  misc_feature: GZ8MTXP02JJDYM.22.36.D03.1.454.CMB.2.raw
  modified_base (298)..(298): a, c, t, g, unknown or other
  misc_feature (298)..(298): n is a, c, g, or t
  modified_base (316)..(316): a, c, t, g, unknown or other
  misc_feature (316)..(316): n is a, c, g, or t
  modified_base (337)..(337): a, c, t, g, unknown or other
  misc_feature (337)..(337): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtctttgactctgtctctggtaccaacacaccagaccaaacccccatcatcattangtgtcactcgtcgccctnaggactctcctcatcgcttcncacggctccaagtctgaccaacgaccgccctaccctaaccactcctcgtgggcctccgtagtttgacggtacgagtcttaacgttattacgtcgtactacgtttacctttaaaagttacggccgtcctacgttcgttcggtttcgggttttcggcgggtacggcgtacggaacgtcgaccgttccgtcggtctacgcccgaaggcctccgccccgtcggtccacgttccg

SEQ ID NO: 356956 - DNA, 630 bp, Homo sapiens
  misc_feature: GZ8MTXP02G0HCR.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatgccatgagttggtccgccgaggcctccgaggggaaggggttgcgaggtgggtcgtcggggagttggaagtgagtggtgccacacaccgtacgcacgacgtccggtgacgggggcctcgttcactcattccaccgagacgacgtacttacccgaaaacacgagtagtaaactctagacaaatcgtacgagtcccgacgacgccgaccggacggaccgaaccgggtcccgttactaccgttcgtcggtacggaaccgtaaaacggtaccctttacgtttaacggttttccggggcccgtaccggggtacccgtaccggttaccggttcgggggacccgtaacccgggg

SEQ ID NO: 356957 - DNA, 563 bp, Homo sapiens
  misc_feature: GZ8MTXP02FTS43.22.36.D03.1.454.CMB.2.raw
  modified_base (218)..(218): a, c, t, g, unknown or other
  misc_feature (218)..(218): n is a, c, g, or t
  modified_base (555)..(555): a, c, t, g, unknown or other
  misc_feature (555)..(555): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgactattgggtcttttgactctgtctcctggtaccaacaacacccaggaccaaaccccccactcatcatttatgtgtcactcgtcggccctcaggagtctcctcatcgcttctcaggcctccaagtctaggaccaacgaccggccctaccctaaaccactcctcgtcgggcctccgagtttagaggacgtacgtacttacttattactgtactagtttacctttaaagtacgcgtcctacttcgtcgttggtttcggcggtacggcaccggtagtcgaccgtccgtacgtcacgcccgaaggctaccgcccctcggaccncgttcccg

SEQ ID NO: 356958 - DNA, 549 bp, Homo sapiens
  misc_feature: GZ8MTXP02GLOE5.22.36.D03.1.454.CMB.2.raw
  modified_base (293)..(293): a, c, t, g, unknown or other
  misc_feature (293)..(293): n is a, c, g, or t
  modified_base (303)..(303): a, c, t, g, unknown or other
  misc_feature (303)..(303): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctctggtaccaacaacacccagccaaacccccancatcatttangtgtcactcgtcggcctcgaggagtctcctcatcgcttctcagctccaagtctgcaacgaccggcctctctaaacccatcctcgtgggtctccgtagtttgaggtacgagttcttacttactttactgtactacgtttaccttaaagttggcgtacctactcgtcgttcggtttcggcggtacgtcgaccgtaagtcgaccgtccgtcggtacaacgcccaaggcctacgccctccggtctacccg

SEQ ID NO: 356959 - DNA, 696 bp, Homo sapiens
  misc_feature: GZ8MTXP02JD9ZC.22.36.D03.1.454.CMB.2.raw
  modified_base (218)..(218): a, c, t, g, unknown or other
  misc_feature (218)..(218): n is a, c, g, or t
  modified_base (304)..(304): a, c, t, g, unknown or other
  misc_feature (304)..(304): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgactattgggtctttgactctgtctctgtaccaacaacaccagaccaaaccccccatcatcattatgtntcactcgtccggccctgaggagtctcctcatcgcttctcacggcctaccaagtcctaggaccaaacgccgccctacccctaaccactccctcgtcgggtcctaccgtaggtttacgaacggtacgtacgttaccttaacttattactcggtaccttaacgtttaacccgtttaaaagttaccggtaccgtaccctaacgtttccgttccgggtttacgggttttcccggggacgggtacgggtaccccgtaaaccggggtaaacggttaccggtaaacccccggttcccgttacccggggttacccgaaccggtaacccccggtaaaaccggggtcccgttaccccgggtaccccccccgtttcggggttacccctaacccgtttcccccgg

SEQ ID NO: 356960 - DNA, 554 bp, Homo sapiens
  misc_feature: GZ8MTXP02GKHMZ.22.36.D03.1.454.CMB.2.raw
  modified_base (292)..(292): a, c, t, g, unknown or other
  misc_feature (292)..(292): n is a, c, g, or t
  modified_base (304)..(304): a, c, t, g, unknown or other
  misc_feature (304)..(304): n is a, c, g, or t
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctctgtaccaacaacaccagccaaacccccacncatcattatgtntcactcgtcggccctcagagtctctcatcgcttctcagctcaagtctgcacncgccctaccctacntctcgtggctccgagtttgacgacgagtcttacttattactgtctacgtttacctttaaattacggctacctacgttcgttcggttgggttttacggcggtaacggccgaaccggtaacgtcgacccggttcctacggtccacggcccgaagggcctccgtcccccgtcggtcctacgttcccg

SEQ ID NO: 356961 - DNA, 674 bp, Homo sapiens
  misc_feature: GZ8MTXP02GW0P3.22.36.D03.1.454.CMB.2.raw
  modified_base (301)..(301): a, c, t, g, unknown or other
  misc_feature (301)..(301): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctcgtggattcacagtcagcagcaatgccatgagttgggccncgaggctccgaggggaaggggttgcgaggtgggtcgtcggggattggaagtgagtggtcgccgacactacgtacgcgaacgacgtccggtggacgggggccctctttacgacttccaactcctacccgaaggaacgtacgtaaccttaaccggaaaaacctacgaacgtaggaaaattccgagaaactaaagtcgtaaaccgacgacccgttacgacggacccggaccggaacgggaccggaaaccggtccccggttacttaccttccggttaggtaccggtaaaccggtaaaacgtacccgttactttaagggttttccggggcccgtccgggtacccgaccgttacggccgggggacccgtaaacccgggg

SEQ ID NO: 356962 - DNA, 534 bp, Homo sapiens
  misc_feature: GZ8MTXP02GC11J.22.36.D03.1.454.CMB.2.raw
  modified_base (218)..(218): a, c, t, g, unknown or other
  misc_feature (218)..(218): n is a, c, g, or t
  modified_base (293)..(293): a, c, t, g, unknown or other
  misc_feature (293)..(293): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggtaccaacaacacccagcaaaccccccancatcatttatggtgtcactcgtcggccctcaggagtctcctcatcgcttctcaggctccaagtctggcaacacggcctaccctaaccatctctgggctccagtttgagacgagtctacttatactgactagtttacctttaaaattaggcgtcctaacttctcgttggtttcggcggtacggacaccgaagtcgaccgtcctcggtcacgtccccaaggctcgccccctcggtcacttccg

SEQ ID NO: 356963 - DNA, 664 bp, Homo sapiens
  misc_feature: GZ8MTXP02HYQUD.22.36.D03.1.454.CMB.2.raw
  modified_base (231)..(231): a, c, t, g, unknown or other
  misc_feature (231)..(231): n is a, c, g, or t
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
  modified_base (343)..(343): a, c, t, g, unknown or other
  misc_feature (343)..(343): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagcatttcctgcactgggaccaanagtgacagtttgggtctttgactctgtctcctaggtaccaacaacacccagacccaaacccccatcatcatttangtntcatcgtcgcctagaggatctcctcatcgcttcncgacgtctacagtcgtacgaccaaccgaccgtaccctaaccctaactactccgtccggtcggtcccttacgtagttacggaacggtaaccgttacgttaacttaaactttaacgttaccgtacgttacgtttaacgttttaaccgtttaaaacgttaccggtaccctacccgtaccgtttccggtttaccgggttttacgggtttaccgggacgggtaacggacccgtaaaccggtaacgtccggtacccgttccgtaccggtaccgaccgtaacccgtaacggtcccgtccccgtacccccgttcgtacctaccgtcccg

SEQ ID NO: 356964 - DNA, 693 bp, Homo sapiens
  misc_feature: GZ8MTXP02IG1W5.22.36.D03.1.454.CMB.2.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacatttgggtcttttgactctgtctcctggtaccaacaacacccagaccaaaccccccatcatcatttatgtgtcactcgtcggccctcaggatctcctcactcgcttctcacggcctccaagtcctacggaccaacgaccggcccctaccctaaaccacttccctcgttcgggcccttacccgtaggttttacgacgggtaccgtacgttcctttaactttaactttaccgtacggtacctttaacgttttaccctttttaaaagttaccggggtcctaccctacgtttccgttccgggtttcggggtttttacccggggcgggtaaacggtccgtaacccgggtaacggttaccggaaccccggtttcccgtaccggggttaccaccgggtaaccccgtaaacgggtcccttacccggtccccccgttccgggtttacctaccccgtttccccgg

SEQ ID NO: 356965 - DNA, 544 bp, Homo sapiens
  misc_feature: GZ8MTXP02IDOIB.22.36.D03.1.454.CMB.2.raw
  modified_base (231)..(231): a, c, t, g, unknown or other
  misc_feature (231)..(231): n is a, c, g, or t
  modified_base (304)..(304): a, c, t, g, unknown or other
  misc_feature (304)..(304): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagcatttcctgcactgggaccaanagtgacattgggtctttgactctgtctcctggtaccaacaacacccaggccaaaccccccaactcatcattangtgtcactcgtcggccctcaggagtctcctcatcgcttctcaggctccaatctgacctacacgccctaccctaaccatctctgggctcagtttgaggacgagtcttacttattactgtctagtttactttaaattaggcgtacctacttcttcggttcggttttcggcggtacggctaccgaacgtcggacccgtccgtacggtcacgcccgaagcctcggccccctcggtctactcccg

SEQ ID NO: 356966 - DNA, 505 bp, Homo sapiens
  misc_feature: GZ8MTXP02I59BM.22.36.D03.1.454.CMB.2.raw
  modified_base (217)..(217): a, c, t, g, unknown or other
  misc_feature (217)..(217): n is a, c, g, or t
  modified_base (249)..(249): a, c, t, g, unknown or other
  misc_feature (249)..(249): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattccgaaaacncagtgaatctgcaaatgtacagcctcagcgccgaggacacggccgtctactctgtgcgaaagacctctattttggccgcggccgactacgtggggccagggcaccctggtcaccgtctctcagcctccaccaacgggcccatcggtcctcccctgcgccctgctccagcgcacctccgagcgcacacgccgcccgtgggctcgcctgcaacggactacttccacgcgtactcgtctgagcggctggcagcgcatag

SEQ ID NO: 356967 - DNA, 551 bp, Homo sapiens
  misc_feature: GZ8MTXP02GRDI0.22.36.D03.1.454.CMB.2.raw
  modified_base (304)..(304): a, c, t, g, unknown or other
  misc_feature (304)..(304): n is a, c, g, or t
  modified_base (399)..(399): a, c, t, g, unknown or other
  misc_feature (399)..(399): n is a, c, g, or t
  modified_base (439)..(439): a, c, t, g, unknown or other
  misc_feature (439)..(439): n is a, c, g, or t
  modified_base (465)..(465): a, c, t, g, unknown or other
  misc_feature (465)..(465): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtctgggggaggcttggtacgaggccgggggggttcctggacactctcctgtgcagcctctggattcacagtcagcagcaatgccatgagttgggccnccaggctcgaggggagggttgcaggtgggtcgtggggatgggaaagtgacgtggtcgacacacaactacgcaacgactccggtggacgggggccncttcatcatctacagagacgattaccgaaaacacaagtanaatcagaactaaagtagaacacaccngacgcgacgagacgcgccgtactactctgacgacgaacgtacctcttagttcggccgaccggaccgacgtacggacgggacgacgg

SEQ ID NO: 356968 - DNA, 627 bp, Homo sapiens
  misc_feature: GZ8MTXP02I35BQ.22.36.D03.1.454.CMB.2.raw
  modified_base (219)..(219): a, c, t, g, unknown or other
  misc_feature (219)..(219): n is a, c, g, or t
  modified_base (353)..(353): a, c, t, g, unknown or other
  misc_feature (353)..(353): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaacagtgactagttggtctttgactctgtctctgtaccaacaccacccagacccaaacccccatcatctattatggtctcacgtccgtccggccctacgaggtacgtctctcactcgcttcncagtcctacagtctggactaacgaccggtccctaccctaaactctcctacgtcgggcctacgtggtttgacggtacgtacgtcttaacttattactcgtacttacgtttaccgtttaaaagtccggaccgtcctacgtttcgttcggtttacgggtttccgggacggtacgaccgtaaaccggtacggtacggtaccgttccgtaccggtacaccggtaaccccgtaacggggtcccttacccggcccccgttccgggtactacccgtttcccg

SEQ ID NO: 356969 - DNA, 582 bp, Homo sapiens
  misc_feature: GZ8MTXP02HX8F6.22.36.D03.1.454.CMB.2.raw
  modified_base (306)..(306): a, c, t, g, unknown or other
  misc_feature (306)..(306): n is a, c, g, or t
  modified_base (325)..(325): a, c, t, g, unknown or other
  misc_feature (325)..(325): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccgggggggtccctgacactctcctgtgcagcctctggattcacagtcagcagcaatgccatgagtggccncaggctcgagggagggttncgagtgggtcgtcggggattgggaagtgagtggtcgccacacactacgcaagacctcggtggacggggccgcgttcagtcactctaccagacgacgtacttaaccgaaaacacagtagtaatctagacaaatcgtaacacgtccacgacgcccgaccggacggaccgaccgggacccttccgtaaccttccgtcggtacgacgaaaacgtaccttacgtttacggttttccggggacccgtcggtacccgtacccgg

SEQ ID NO: 356970 - DNA, 587 bp, Homo sapiens
  misc_feature: GZ8MTXP02IJCYH.22.36.D03.1.454.CMB.2.raw
  modified_base (399)..(399): a, c, t, g, unknown or other
  misc_feature (399)..(399): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcagcctctggattcacagtcagcagcaatgccatgagttgggtccgccaggcctccgaggggaggggttcgcgaggtgggtcgtcggggtattgggaagtgagtggtgccacacactacgcagactccggtgacgggggccncgttcatcatctccagacgacgacttaccgaaaacacagtagaatctagacaaatgtaacacgcctacgacggccgaccgacggaccgaccggcccgttctaccttcgtacgtacgaccgtaaacgtacccttcgttaacgttttccgggccgacggtacccgacgtaccggtcggggaccgaccggg

SEQ ID NO: 356971 - DNA, 678 bp, Homo sapiens
  misc_feature: GZ8MTXP02F211E.22.36.D03.1.454.CMB.2.raw
  modified_base (318)..(318): a, c, t, g, unknown or other
  misc_feature (318)..(318): n is a, c, g, or t
  modified_base (394)..(394): a, c, t, g, unknown or other
  misc_feature (394)..(394): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggagcttggtacaggccggggggtcctgacactctcctgtgcagcctctggattcacagtcagcagcaatgccatgagtggccgcagctcgagggaagggttncgaggtgggcgtcggggatggaaagtgacgtggtcgacctaacacactacgctacgactccggtaggacggggccncttcatcatcctaccgagaacgtacgaacttaacccggaaaaactacgaagtagaaaacttcctaaggaaacctaaaagttcgtaaaccgacgtaccctacgaacggcccggaccccggaaggaaccccgtaacggggcccctttacgttaaccgtttccgtaggttaccggaaaccgtaaaaacgttaccccgttacgttttaaacggttttccgggggaccccgtaccggggtacccggttaaccgtaccggggttaccgggggacccgtaaaccccggggg

SEQ ID NO: 356972 - DNA, 539 bp, Homo sapiens
  misc_feature: GZ8MTXP02IL6T0.22.36.D03.1.454.CMB.2.raw
  modified_base (275)..(275): a, c, t, g, unknown or other
  misc_feature (275)..(275): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaanacccagcaaacccccactcatcatttatgtgtcactcgtcggccctcaggacgtctcctcatcgcttctcagctccaaatctggcaacaccgccctccctaaaccatctctggctccagtttgagtacgagtctacttattactgtctagtttaccttaaattacggcgcctactcttcgtggttttcggcggtacgggtcaccggaaacgtcgtaaccgtcctcggtcacgcccgaaggcctcggccccctcggcctactccc

SEQ ID NO: 356973 - DNA, 537 bp, Homo sapiens
  misc_feature: GZ8MTXP02GHANC.22.36.D03.1.454.CMB.2.raw
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggaccaaaccccccaactcatcatttanggtntcactcgtcgccctcgaggagtctcctcatcgcttctcagcctcaagtctgcaacncgcctcccaacatcnctggctccagttgaggacgagtactattacttatagctagtttaccttaaattacgcgtacctactctcggttggttttcggcggtacggccgaacgtaagttcgaccgttcctacggtcacgtccgaaggctacgcccctcggtccacttccg

SEQ ID NO: 356974 - DNA, 660 bp, Homo sapiens
  misc_feature: GZ8MTXP02JBBVY.22.36.D03.1.454.CMB.2.raw
  modified_base (308)..(308): a, c, t, g, unknown or other
  misc_feature (308)..(308): n is a, c, g, or t
  modified_base (333)..(333): a, c, t, g, unknown or other
  misc_feature (333)..(333): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggtcgttggtacgaggccggggggtccctgacactctcctgtgcagcctctggattcacagtcagcagcaatgccatgagttgggtcccncgaggcctccgaaggggaggggttnacgaggtgggtcgtcggggattggaagtgagtgggcgccacacactacgccgagtaccgtcccggtagggacgggggtcccctcgtttacgaactccgtaacttcccgtacccgaagaacgaacccgtaacgtttaaaccccggaaaaactaaccgagtacgaaacttcctaggacctaaaagtcgtaacgacgccctacgacgccggaccggacggaaccgacggtcccgtcttaccgtttcgtcgtacggtacgaaacggtaccttactttacggttttcggggcccgcggtaccccgacgtaccggtcggggtacccaccgggg

SEQ ID NO: 356975 - DNA, 658 bp, Homo sapiens
  misc_feature: GZ8MTXP02JS6NF.22.36.D03.1.454.CMB.2.raw
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttgggtacagggcccggggggtccctgacactctcctgtgcagcctctggattcacagtcagcagcaatgccatgagtggccncaggcncgagggagggttgcgaggtgggtcgtcggggagttgggaagtggagtgggtcgcccacaccgactaccggcagtaccgtccggtagggacggggcccgtcgttcgatcaatcctaccgagacgacgtacttacccgaaaacgccaagtagaactcgttacgaactaaacgtttacgaaccgaacgtcccttaccgaacggcccggacccgggaaacgggaccccggtaacccgggttccccggttacctttaaaccgttccgtggtaccgaaccggtaaaacgtcccgtttacgtttaacgggtttttccgggccccggtaccgggtacccggtaaacccggg

SEQ ID NO: 356976 - DNA, 558 bp, Homo sapiens
  misc_feature: GZ8MTXP02JDV1Y.22.36.D03.1.454.CMB.2.raw
tcagacatacgcgtcacgaccggtgctcgatttagctgcgtcacgatctctcttggggagatctgagagaggagcccagccctgggattttcaggtgttttcatttggtgatcaggactgaacagagagaactcaccatggagtttgggctgaagtggcttttgcttgtggctattttaaaggtgtcaagtgtgcggtgaaggtattggagtcgtgggggaggcttgggtacaggccgggggggtccctggacactctcctgtgcagcctctggattcacagtcagcagcaatgccatgagttggtccgcaggctccgaggggaggggttgcgagtgggtcgtcggggattggaagtgagtttttggcgccacacacgtacgcagacgtccggtggacggggccgcgttcactcatctccagagacgactaccgaaaacacagtagaatctagacaaagtcgtacacgcctcacgcgaccggacgaccgaccggccgtactacgttcgtacgtcgacgaacgtaccttacgttacgtttcggccgtccggccgtaccg

SEQ ID NO: 356977 - DNA, 606 bp, Homo sapiens
  misc_feature: GZ8MTXP02F593D.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcttggtacgaggccggggggtccctgacactctcctgtgcagcctctggattcacagtcagcagcaatgccatggagttgggtccgccgaggctccgaggggaaggggttgcgtaggtgggtcgtcggggattggaagtgagtggtcgcacacactacgcgaagacctccggtaggacggggtcccgcgttcactcactctacccgagacgacgtaacttaaccgaaaacacgagtagaaatcgtagactaaagtcgtaacacgcctacgacgccgaccggacggacgaccgcccgttctacttcgtcgtcgacgtaaacgaccgttcgttaacggttttcgggcccgtaccgggtacccgtacggtaccggtacgggccgaccggg

SEQ ID NO: 356978 - DNA, 579 bp, Homo sapiens
  misc_feature: GZ8MTXP02H4EAC.22.36.D03.1.454.CMB.2.raw
  modified_base (230)..(230): a, c, t, g, unknown or other
  misc_feature (230)..(230): n is a, c, g, or t
  modified_base (298)..(298): a, c, t, g, unknown or other
  misc_feature (298)..(298): n is a, c, g, or t
  modified_base (312)..(312): a, c, t, g, unknown or other
  misc_feature (312)..(312): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcattcctgcactgggaccaanagtgacattggtctttgactctgtctctgtaccaacacaccagaccaaacccccatcatcattatgtntcactcgtcgcctnagagtctctcatcgcttctcacgctcaagtctacggacaacaccggcctaccctaacactctactcgggctccgtagttgacgacgagtctaacttattaactgtacgtagtttacctttaaagttacggctacctacttcgtcggtttcggtttcgggacggtaacggtccgtaaaccggtaaaggtcgtaacccgttccgtaccggtcaacggacccaaacggtcccgtaccgcccccgttcggtacctactttccgttccccgg

SEQ ID NO: 356979 - DNA, 585 bp, Homo sapiens
  misc_feature: GZ8MTXP02FVHPQ.22.36.D03.1.454.CMB.2.raw
  modified_base (304)..(304): a, c, t, g, unknown or other
  misc_feature (304)..(304): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccgggggggtccctgacactctcctgtgcagcctctggattcacagtcagcagcaatgccatgagttgggtccncaggctccgaggggaggggttgcgaggtgggtcgtcggggattgggaaagtgagtgggtcgccacacgactacgcagaccgtccggtagacggggccctcttcacgtcactctaccgagacgacgacttaccgaaaacacagtagaatctagacaaatcgtacagcctacgacgcgaccgacggaccgacggccgtactacttcgtacgtacgacgtaaacgtacctacgttacgttttcgggacccgtcggccgtacgtacggtcggggaccgaccgggg

SEQ ID NO: 356980 - DNA, 524 bp, Homo sapiens
  misc_feature: GZ8MTXP02IAQQZ.22.36.D03.1.454.CMB.2.raw
  modified_base (218)..(218): a, c, t, g, unknown or other
  misc_feature (218)..(218): n is a, c, g, or t
  modified_base (306)..(306): a, c, t, g, unknown or other
  misc_feature (306)..(306): n is a, c, g, or t
  modified_base (491)..(491): a, c, t, g, unknown or other
  misc_feature (491)..(491): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggacctaacaacacccaggccaaacccccaactcatcatttanggtgtcactcgtcgccctcaggatctcctcatcgcttctcagctccaagtctggcaacacgccctccctaacatctctgggctccagtttgaggacgagtctacttattactgtactagtttaccttaaattacggctcctactcttcgttggttttcggcggtaggcaccgagtcgaccgtccncgtcacgcccgagctcgcccctcggtcactccg

SEQ ID NO: 356981 - DNA, 637 bp, Homo sapiens
  misc_feature: GZ8MTXP02F3XEZ.22.36.D03.1.454.CMB.2.raw
  modified_base (217)..(217): a, c, t, g, unknown or other
  misc_feature (217)..(217): n is a, c, g, or t
  modified_base (249)..(249): a, c, t, g, unknown or other
  misc_feature (249)..(249): n is a, c, g, or t
  modified_base (450)..(450): a, c, t, g, unknown or other
  misc_feature (450)..(450): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattccgaaaacncagtgaatctgcaaatgtacagcctcagcgccgaggacacggccgtctacttctgtcgacgaaaacgacctcttagtttttcggggccgcggccgacctacgtggggccagggcacccgtggtccaccgtctcttcacgcctccaccgaaacgggcccacgtccggtccttccccctggccgcccctgcctccgacggacnccgacccgtaccgacgacgccaccgacggcccggcccgtcggggccttcgggaccttcggggtaccaaacgggtaccttaacccgtttccgaaaccgggtccgttaaacgttcgggtttaccggtacgggtaccggggtccggggtaccggttacggggaccggtaacgggtccgaccgtacgtacg

SEQ ID NO: 356982 - DNA, 538 bp, Homo sapiens
  misc_feature: GZ8MTXP02IKUPB.22.36.D03.1.454.CMB.2.raw
  modified_base (306)..(306): a, c, t, g, unknown or other
  misc_feature (306)..(306): n is a, c, g, or t
  modified_base (328)..(328): a, c, t, g, unknown or other
  misc_feature (328)..(328): n is a, c, g, or t
  modified_base (366)..(366): a, c, t, g, unknown or other
  misc_feature (366)..(366): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggctttttgcttgtggctattttaaaaggtgtcaagtgtgcggtgaaggtattggagtctgggggaggcttggtacaggccggggggtccctgacactctcctgtgcagcctctggattcacagtcagcagcaatgccatgagttggccnccaggctccgaggggagggttncgagtgggtctggggattgggaagtgattggtgcccanacactacggcagactccggtgacggggccgcttcatcatctccagacgacgactaccgaaaacaccgaagtagaatctagacaaatcgtacagcctcgacgcgccgacggacgacggccgtctactcgtgtcgacgaacgacctacgttacgtttcggccgtcggccgtacg

SEQ ID NO: 356983 - DNA, 581 bp, Homo sapiens
  misc_feature: GZ8MTXP02GNIDY.22.36.D03.1.454.CMB.2.raw
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (347)..(347): a, c, t, g, unknown or other
  misc_feature (347)..(347): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactagttgggtctttgactctgtctcctggtaccaacaacacccagaccaaacccccatcatcatttangtntcactcgtcggccctgagtacgtctcctcatcgtcttcncacggctaccaagtcgtagacctaaacgaccgccctaccctaaccatcctcgtcgggccttccgagtttacgaggtacgacgttcttaaactttattacgtacgtctacgtttaaccctttaaaagttacggccgtacccacttcgttcggttcgggtttcggacggtacggcctaccgaagtcgaccgtcctcggcacgaacccgacggctaccgccccgtcgtacctctccg

SEQ ID NO: 356984 - DNA, 645 bp, Homo sapiens
  misc_feature: GZ8MTXP02HH5R4.22.36.D03.1.454.CMB.2.raw
  modified_base (409)..(409): a, c, t, g, unknown or other
  misc_feature (409)..(409): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcagcctctggattcacagtcagcagcaatgccatgagttgggtccgccaggctccgaaggggaaggggttgcgtaggtcggggtctcgggggtattgggaaagtgagtggtcgccacacaccgtacgcacgacgtccggtggacgggggccncttacgatcatcaccgagacgacgacttaccgaaaacacgagtagaatctagactaaagtgtacaagcctacgacggccgaccgacggaccgaaccgggtcccgttacgtaaccgtttcgtacggttacggaaccgtaaaacgggtacccctttacgttttaacggtttttcggggaccccggtccgggtacccggtaaaccgttccgggttaccgggggtacccgaacccggggg

SEQ ID NO: 356985 - DNA, 587 bp, Homo sapiens
  misc_feature: GZ8MTXP02HKBNI.22.36.D03.1.454.CMB.2.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (300)..(300): a, c, t, g, unknown or other
  misc_feature (300)..(300): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaanagtgactattgggtctttgactctgtctctgtaccaacacaccagaccaaacccccatcatcatttanggtagtcactcgtcgccctgaggtagtctccctcactcgcttctcacggcctacccaaagttcctcggaccaaccgaccggtccctaccctaaaccacttcctcgtgggcctcctacggtttggacggtacgagtctttaacttagttactggtacttacggtttacctttaaaagttcggcctaccgtacttcgttcggttcggtttacggcggtacgtcgacgtaagtcgtacccgtcgtcggtcacgcccgaaggccgtccgccccgttcggtacctacgtccg

SEQ ID NO: 356986 - DNA, 546 bp, Homo sapiens
  misc_feature: GZ8MTXP02GLPGJ.22.36.D03.1.454.CMB.2.raw
  modified_base (540)..(540): a, c, t, g, unknown or other
  misc_feature (540)..(540): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccgcttcatcatctccagagacgattccgaaaacacagtgaatctgcaaatgtacagcctcagcgccgaggacacgggccgtctacttctgtgcgaaagacctctatttttgggccgcggccgaccgtactggggccagggcaccctggtcaccgtctcttcacgcctccaccaacgggcccagtccggtccttcccccgtggccgcccctgcctcccaggacgccaccctccgacgagccacacgccggcccgtggggctcggcctgggtcaagggtacctacttcccacgcgtacgtcgtacgtgacgcgggctcgggcaagggcncagtag

SEQ ID NO: 356987 - DNA, 622 bp, Homo sapiens
  misc_feature: GZ8MTXP02H8O8Q.22.36.D03.1.454.CMB.2.raw
  modified_base (217)..(217): a, c, t, g, unknown or other
  misc_feature (217)..(217): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagcatttccngcactgggaccaacagtgacattgggtctttgactctgtctcctggtaccaacaacacccaggacccaaaccccccaactccatcaatttatggtgtcactcgtcggccctcgaggacgtctcctcatcgcttctcgacggctaccaaagtcctggaccaacgacgtacccctacccctaaaccactcctccgttcggggcccttacccgtaggttttacgacgggtaccgtagttacctactttacttacctgtacttacgtttaacctttaaagtttacgaccgtcctaacgtcgttcggttggttttacggacggtacggaccgtaccggaagtacggtaccgtccgtaccggttcaacgtaacccgaacgccgtcgcccccgtcggtacctaccgttcccg

SEQ ID NO: 356988 - DNA, 553 bp, Homo sapiens
  misc_feature: GZ8MTXP02ILSTZ.22.36.D03.1.454.CMB.2.raw
  modified_base (353)..(353): a, c, t, g, unknown or other
  misc_feature (353)..(353): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
  modified_base (453)..(453): a, c, t, g, unknown or other
  misc_feature (453)..(453): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtcctgacactctcctgtgcagcctctggattcacagtcagcagcaatgccatgagttgggtccgcaggctccgaggggagggttgcgaggtgggtctcggggatggaagtgatggtnccacgacactacgcagacctccggtgacggggcncttcatcatcncagacgacgacttaccgaaaacacgagtagaatctagactaatgtacgacgcctnacgcgaccgagtaccgcgcccgtctacttccgtgtacgaacgaacgtaccttacttacgttttcggccgtccggaccgtacgtacgtcgggccgaccggg

SEQ ID NO: 356989 - DNA, 573 bp, Homo sapiens
  misc_feature: GZ8MTXP02FRKP8.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaactccatcatttatggtgtcactcgtcggccctcaggagtctcctcatcgcttctcaggctccaagtctggcaacacggccctccctaaccactctctggcctcagtttgaggcgagtcttacttattactgtctagttacctttaaattacggtcgtccacgttcctcggttcggtttttacgggcgggtacggtcgaccggaaacgtttcggaacccgttcccgtaccggtcgaacgcccgtaaacggccgtcgcccccctcgggtccacgttcccg

SEQ ID NO: 356990 - DNA, 689 bp, Homo sapiens
  misc_feature: GZ8MTXP02G4G4E.22.36.D03.1.454.CMB.2.raw
  modified_base (236)..(236): a, c, t, g, unknown or other
  misc_feature (236)..(236): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
  modified_base (335)..(335): a, c, t, g, unknown or other
  misc_feature (335)..(335): n is a, c, g, or t
  modified_base (347)..(347): a, c, t, g, unknown or other
  misc_feature (347)..(347): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaacccaanagtgactagttggtctttgactctgtctcctggtaccaacaacaccagacccaaaacccccatcatcatttangtntcactcgtcgcctgaggatctcnctactcgcttcncgagcctaccaagtcgtagaccaacgaccgccctaccctaaccactctcgtacggtccttccgtaggtttcgaggtacgtacgttacttaacgtttattaacgtcgtacgttaacgttttaccttttaaaagttaccgggtacctacccgttaacgttccgtttaccggggtttacgggttttaccgggggaccgggtaacggtaacccggtaaccggttaaacgggttcccgggtaaaccccggttccccgttaccggggtacccgtaaccggaaccccggtaaacggtcccggttccccggtaccccccggtttcggttaccccggtacctttcccccgg

SEQ ID NO: 356991 - DNA, 575 bp, Homo sapiens
  misc_feature: GZ8MTXP02FODMF.22.36.D03.1.454.CMB.2.raw
  modified_base (283)..(283): a, c, t, g, unknown or other
  misc_feature (283)..(283): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcttgggtacgaggccggggggtccctggacactctcctgtgcagcctctggattcacngtcagcagcaatgccatgagttggtccgccaggcctccgaggggaaggggttgcgaggtgggcgtggggattgggaagtgagtggtgccacgacactacgcagtacgtccgggtgacggggcccgtcttcgatcaactctccagagacgtaactaccgaaaacacagtagaactctagaccaaatgtaacacgtacctacgacgccgacggacggaccgacggtacccgtctacttccgtagtacgacgaaacgtaccttacttcggttttacgggccgtccggaccgtacg

SEQ ID NO: 356992 - DNA, 727 bp, Homo sapiens
  misc_feature: GZ8MTXP02INCCJ.22.36.D03.1.454.CMB.2.raw
  modified_base (276)..(276): a, c, t, g, unknown or other
  misc_feature (276)..(276): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtggcggtgaaggtattggagtcgtgggggaggcttggtacgaggccggggggtccctgacactctcctgtgcagcctctggattcacngtcagcagcaatcgccagtggtaggttcgggtcccgccgaggcctaccggaggggtaaggggttgcgtagggtcggggtcgtcggggtagttagggaagtggagtgggtcacccacacgacctacgctaacgaccgtcccgggtggggaaccgggggtcctcctttcacgttccaacttcccgtaccgaggaacgtaaccgtaaaccgttaaccccgaaaaaaccgacgtacggtaacgtaaaacttccgttaacggaaacttaaaagttcggtaaacccaacgtcccgtacgaacggcccggacccggaacgggaacccgtaaccgggtccccgtttaccgttaccgtttcgtacggttacggaaaccgtaaacgtaccccgtttagttttacggtttccggggcccgtacgggtacccgtacgtaccgggtccggggaccgtaccgggg

SEQ ID NO: 356993 - DNA, 614 bp, Homo sapiens
  misc_feature: GZ8MTXP02JZ0R6.22.36.D03.1.454.CMB.2.raw
  modified_base (303)..(303): a, c, t, g, unknown or other
  misc_feature (303)..(303): n is a, c, g, or t
  modified_base (419)..(419): a, c, t, g, unknown or other
  misc_feature (419)..(419): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacgaggccgggggggtccctggacactctcctgtgcagcctctggattcacagtcagcagcaatgccatgagttgggccncaggctccgaggggaaggggttgcaggtgggtcgtcggggattgggaagtgagtgggtgcccaacgcaactacgcacgactcccggtagacgggggcccgcttcgattcaacttcncccaaggacgacgaattacccggaaaaacacgagtacgaaatctagactaaagtcgtacaacgcctacgacgccggaccgagggaccgaccggtcccgtacttaccttccgtaggttacgacgaaacgtacccttcgtttacggttttcggggcccgcgggtcccgtaccgtacggtcgggggacccaccggggg

SEQ ID NO: 356994 - DNA, 616 bp, Homo sapiens
  misc_feature: GZ8MTXP02I2N8D.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacgaggccgggggggtccctggacactctcctgtgcagcctctggattcacagtcagcagcaatgccatgagttggtccgccaggctccgaggggaggggttgcgagtgggtcgtcggggattgggaagtgagttggtcgccacacactacgcagactccggtgacggggccgcttcatcatctcccagagacgacttaccgaaaacacgagtacgaatctagaccaaaatcgtaacacgaccctcaacggccgaccggaacgggaacccgaaccggggtcccggttaccgttaacctttcgtacggttacggaaccggtaaaacgtaccccgtttacgtttaacggtttttccgggggcccggtccggggtacccgttaacccggg

SEQ ID NO: 356995 - DNA, 539 bp, Homo sapiens
  misc_feature: GZ8MTXP02GU6FL.22.36.D03.1.454.CMB.2.raw
  modified_base (218)..(218): a, c, t, g, unknown or other
  misc_feature (218)..(218): n is a, c, g, or t
  modified_base (304)..(304): a, c, t, g, unknown or other
  misc_feature (304)..(304): n is a, c, g, or t
  modified_base (308)..(308): a, c, t, g, unknown or other
  misc_feature (308)..(308): n is a, c, g, or t
  modified_base (379)..(379): a, c, t, g, unknown or other
  misc_feature (379)..(379): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcacgtgggaccaacagtgacagttgggtctttgactctgtctcctggtaccaacaacaccagaccaaacccccatcatcatttanggtntcactcgtcggccctcaggacgtctctcatcgtcttctcagcctcaagtctgcaacgcgcctaccctaacntctcgtcggcttcagttgacggacagtacttacttattactgtacttagtttacctttaaattcggactcctacttcgttcggttcggtttcggcggtaggcgtacgtacgtcgaccgtctcggtcacgccgacggcctcgcccccgtggtccacttccg

SEQ ID NO: 356996 - DNA, 576 bp, Homo sapiens
  misc_feature: GZ8MTXP02IWL8S.22.36.D03.1.454.CMB.2.raw
  modified_base (304)..(304): a, c, t, g, unknown or other
  misc_feature (304)..(304): n is a, c, g, or t
  modified_base (390)..(390): a, c, t, g, unknown or other
  misc_feature (390)..(390): n is a, c, g, or t
  modified_base (401)..(401): a, c, t, g, unknown or other
  misc_feature (401)..(401): n is a, c, g, or t
  modified_base (504)..(504): a, c, t, g, unknown or other
  misc_feature (504)..(504): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccgggggggtccctggacactctcctgtgcagcctctggattcacagtcagcagcaatgccatgagttgggccnccaggctccgaggggaaggggttgcgaggtgggtcgtcggggattgggaagtgacgtggtgcccacacactacgcagacctccggngacgggggccncttcatcatctaccagagacgacttaaccgaaaacacgagtagaaactctagacaaatcgtacacgcctcgaggccgaccgagacacggccgtactacttcgngtcgacgaaacgtacctctttacgtttcggggcccgtacgggccgtacgtaccggtcggggacccgacgggg

SEQ ID NO: 356997 - DNA, 735 bp, Homo sapiens
  misc_feature: GZ8MTXP02JW7GZ.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacgagggccgggggggtccctgaccactctcctgtgcagccctctggattcacagtcagcagcaaatgaccatggtaggtttcgggtccccgccgagggcctaccggaagggggtaacggggtttgccgagggttggggtcgtcgggggtaatttggggaaagttggaacgtggggtcgaccacacgtactacgccacgaccttccggtggacgggggccctcttacgacttcacttccctacccgaggaacgaaccgacgttaacccgaaaaaccacgaagtacggaaatcccgttagactaaagtagtacaacggccctacgaacggccggacccggaacgggtacccgaccggggtccccgttacttaaccgttttccggacggttacggaaaccgtaaaaacccgggtccctttacccggtttaaggtttttcccgggggccccgggttcccgggtacccgggtaaacccgttaccgggttacggggggaccccgtaaaccggggg

SEQ ID NO: 356998 - DNA, 586 bp, Homo sapiens
  misc_feature: GZ8MTXP02HMNTJ.22.36.D03.1.454.CMB.2.raw
  modified_base (220)..(220): a, c, t, g, unknown or other
  misc_feature (220)..(220): n is a, c, g, or t
  modified_base (253)..(253): a, c, t, g, unknown or other
  misc_feature (253)..(253): n is a, c, g, or t
  modified_base (446)..(446): a, c, t, g, unknown or other
  misc_feature (446)..(446): n is a, c, g, or t
tcagacatacgcgtcacgaccggtgctcgatttagctgcgtcacgatctctcttgggtttttgggggggtccctgacactctcctgtgcagcctctggattcacagtcagcagcaatgccatgagttgggtccgccaggctccgaggggaaggggttgcagtgggtctcggggattggaagtgatggtgccacacactacgcagactccgtgaggggccncttcatcatctccagagacgattaccgaaaacncagtgaatctgcaaatgtacagcctcagcgccgaggacacggccgtctacttctgtgcgaaagtacctcttagtttttcgggccgcggccgacctacgtggggccagggcacccgtggtccaccgtctcttccacgcctccaccgaacgggcccagtccgtcccttccccctggccgccctgcctccgaggcnccacccgtccgagacgccacgacgccggcccgtgggcctcgccgtgggtacgaaacgggtaccttaccgttcccaaccggtcgttaactcgtccgtcggacggccggggtcgtcggggacgaaacgggccgacgaagtgg

SEQ ID NO: 356999 - DNA, 638 bp, Homo sapiens
  misc_feature: GZ8MTXP02G0SJW.22.36.D03.1.454.CMB.2.raw
  modified_base (311)..(311): a, c, t, g, unknown or other
  misc_feature (311)..(311): n is a, c, g, or t
  modified_base (331)..(331): a, c, t, g, unknown or other
  misc_feature (331)..(331): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggagcgttggtacgagggccggggggtccctgacactctcctgtgcagcctcgtggattcacagtcagcagcaatgccatgagttggccncgaggctcgaggggtaggtncgaggtggtcgtcggggattgggaagtgagtggcgccacgacactacgcacgaccgtccggtgggacggggcctcgttacacgtcctatcctacccgaaggaacgaaccgtacgttaaacccgaaaactacgaagtacgtaactcgtacgaactaaagttcgaacgacgtacctacgacggccggacccggaacggacccgtaaccgggtcccgttaacgttaccgttcgtacggtacggaacgaaaaccgttaccgttacgtttaacggttttccggggacccgtccggggtacccgttaaccggg

SEQ ID NO: 357000 - DNA, 567 bp, Homo sapiens
  misc_feature: GZ8MTXP02JFP33.22.36.D03.1.454.CMB.2.raw
  modified_base (219)..(219): a, c, t, g, unknown or other
  misc_feature (219)..(219): n is a, c, g, or t
  modified_base (251)..(251): a, c, t, g, unknown or other
  misc_feature (251)..(251): n is a, c, g, or t
  modified_base (319)..(319): a, c, t, g, unknown or other
  misc_feature (319)..(319): n is a, c, g, or t
  modified_base (370)..(370): a, c, t, g, unknown or other
  misc_feature (370)..(370): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccaggggaaggggttgcagtgggtctcggggattggaagtgatggtgccacacactacgcagactccggtggaggggccncttcatcatctccagagacgattaccgaaaancagtgaatctgcaaatgtacagcctcagcgccgaggacacggccgtctacttctgtgacgaaagcctnttacgttttgggccgcggccgacctacgtcggggccagggtaccctggtcnccggtctcgttcacgcctccaccacgggcccagtccggtccttcccccgtggcccgccctcgcctccgaggacgccacctccgagacgccacgacgccggcccgtgggcctcgccgtggtcgaacgggcctaaccgttccgaccgcgttatcgtccgtagcggcgggccgtggaccgtacgggcgactaacgtcgcg

SEQ ID NO: 357001 - DNA, 647 bp, Homo sapiens
  misc_feature: GZ8MTXP02HEXS5.22.36.D03.1.454.CMB.2.raw
  modified_base (302)..(302): a, c, t, g, unknown or other
  misc_feature (302)..(302): n is a, c, g, or t
  modified_base (320)..(320): a, c, t, g, unknown or other
  misc_feature (320)..(320): n is a, c, g, or t
  modified_base (394)..(394): a, c, t, g, unknown or other
  misc_feature (394)..(394): n is a, c, g, or t
  modified_base (408)..(408): a, c, t, g, unknown or other
  misc_feature (408)..(408): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccgggggggtccctgacactctcctgtgcagcctcgtggattcacagtcagcagcaatgccatgagtggccncgagctcgagggagggtncgaggtgggtctcggggattggggaaagttgagtgggtcgaccacgaccacgtacgcgtacgtaccgttccggnggacgggggtcccngtttaccatcgactcctcgaagacgacgtacgtaccgaaaacacgacgtagaactcgtagacctaaagtcgtaacgacgtaccgtacgacggaccgaccgggacggaccgacccggtcccgttacgttaccgttaaccgttcggtacggaaaccggtaaacgtaacccgttcgtttaaacggttttccggggccgtaccggggtacccgtacgtaccggtcgggggaccctaaccgggg

SEQ ID NO: 357002 - DNA, 572 bp, Homo sapiens
  misc_feature: GZ8MTXP02FQCWA.22.36.D03.1.454.CMB.2.raw
  modified_base (216)..(216): a, c, t, g, unknown or other
  misc_feature (216)..(216): n is a, c, g, or t
  modified_base (249)..(249): a, c, t, g, unknown or other
  misc_feature (249)..(249): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccncttcatcatctccagagacgattaccgaaaacncagtgaatctgcaaatgtacagcctcagcgccgaggacacggccgtctacttctgtgcgaaagcctcttattttggccgcggccgacctacgtggggccagggcaccctggtcaccgtctcttcagcctccacccgaacgggcccactccggtccttcccccgtggcccgcccctcgcctcccacggcgcaccctccgacgacgcacacgcccggcccgtgggccttcggcccgtggtccaaacgggtaccttaccgttcccgaacggtccgtaacttcgttcctggacggcggggcgtcgggaccgaagggccgcgatacgg

SEQ ID NO: 357003 - DNA, 559 bp, Homo sapiens
  misc_feature: GZ8MTXP02GH5S1.22.36.D03.1.454.CMB.2.raw
  modified_base (222)..(222): a, c, t, g, unknown or other
  misc_feature (222)..(222): n is a, c, g, or t
  modified_base (255)..(255): a, c, t, g, unknown or other
  misc_feature (255)..(255): n is a, c, g, or t
  modified_base (534)..(534): a, c, t, g, unknown or other
  misc_feature (534)..(534): n is a, c, g, or t
  modified_base (544)..(544): a, c, t, g, unknown or other
  misc_feature (544)..(544): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgaggggaaggggttgcaggtgggtctcgggggattggaagtgatgggtgccacacactacgcagactccgtgaggggccncttcatcatctccagagacgattaccgaaaacnagtagaatctgacaaatgtacagcctcagcgccgaggacacggccgtctacttctgtgacgaaaagacctacttagtttttcgggccgcggccgaccgtacgtcggggccacgggcacccgtgtcaccgtctcttccacgcctaccaccaacgggcccaacgtccggtcccttcccctcgcccgccctgccctcgacgcgaccaccgtccgacgacgcacgagcccgccgtcgggctcgccgtcgtacaacggactaccttccgaacgcgtactcgtcnggagcgggcncggacgagcgcagag

SEQ ID NO: 357004 - DNA, 578 bp, Homo sapiens
  misc_feature: GZ8MTXP02IPQ1F.22.36.D03.1.454.CMB.2.raw
  modified_base (393)..(393): a, c, t, g, unknown or other
  misc_feature (393)..(393): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaaggtgtcaagtgtgcggtgaaggtattggagtcgtgggggagcttggtacaggccgggggggtccctgacactctcctgtgcagcctctggattcacagtcagcagcaatgccatgagttgggtccgccaggctccgaggggaaggggttgcaggtgggtctcggggattggaaagtgatggtgccacacactacgcagactccggtgacgggggcncttcatcactctccagagacgacttaaccgaaacacagtagaaatctagactaaatgtacacgcctcaacgcgacgacgacgacggccgtactacgttctcgtacgacgtaaacgtaaccttcgtttaacggtttttcgggcccggtcggtcccgaacgtaccggtacggggacccgaaccgggg

SEQ ID NO: 357005 - DNA, 608 bp, Homo sapiens
  misc_feature: GZ8MTXP02JA06A.22.36.D03.1.454.CMB.2.raw
  modified_base (357)..(357): a, c, t, g, unknown or other
  misc_feature (357)..(357): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgacattgggtctttgactctgtctcctggtaaccaacaacaccacgacccaaaccccccaactcatctatttatggtgtcactcgtccggccctcgaggacgtctcctcgtactcgcttcncagtcctacctaaagtcctacgacaaaccgaccgtccctacccctaaaccactacctcgtcgggtccctactacggtttagacggacgtagtcttaactttacttactgtacctagtttacctttaaagtacgtccgtacctacttcgttcggttcgggtttccggacggttacggacgtaccggtaaagtccgtacccgtacgtccggtacacgccgaacggtccgtcgccccgtccgtacctcttcccg

SEQ ID NO: 357006 - DNA, 516 bp, Homo sapiens
  misc_feature: GZ8MTXP02INP1G.22.36.D03.1.454.CMB.2.raw
  modified_base (217)..(217): a, c, t, g, unknown or other
  misc_feature (217)..(217): n is a, c, g, or t
  modified_base (307)..(307): a, c, t, g, unknown or other
  misc_feature (307)..(307): n is a, c, g, or t
  modified_base (379)..(379): a, c, t, g, unknown or other
  misc_feature (379)..(379): n is a, c, g, or t
tcagacatacgcgtcacgaccggtgctcgatttagctgcgtcacgatctctcttggggtgggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgactattgggtctttgactctgtctcctggtaccaacaacaccaggaccaaaccccccatcatcatttatgtntcactcgtcggtctcaggagtctctcatcgcttctcacggctccaagtctgcaacacgcctccctacactcnctggtctcagtttgagacgagtcttacttattactgtcacgtttacttaaagtacgcgacctactcgtcgttcggtttcgcggtagcacgagtcgacgtcctacgtcacgccgaacgctcgccctcggtcacgtccg

SEQ ID NO: 357007 - DNA, 667 bp, Homo sapiens
  misc_feature: GZ8MTXP02H4Y0C.22.36.D03.1.454.CMB.2.raw
  modified_base (349)..(349): a, c, t, g, unknown or other
  misc_feature (349)..(349): n is a, c, g, or t
  modified_base (383)..(383): a, c, t, g, unknown or other
  misc_feature (383)..(383): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgactagttggtctttgactctgtctcctggtaccaacaacacccaggaccaaaccccccaactcatcattatggtgtcactcgtcgccctcagagtctcctcatcgcttctcncgctccgaagtctgccaacgcgccctccctaacnctctcgtgggcctccgtagtttggacggtacgtagtccttacgtttaacttactcgtactacgtttaccttttaaaagttacggtacctccgtaacgttccgttccggttttacggggtttttccgggccggggttaacgggtaccgtaacccgggtaaacgggttacccggtaacccggttccccgttaccgggggtaccctaaccgggtaaccccgtaaaccggggtcccttacccgggtacccccccgttccggggttaccctaacccggttttcccccgg

SEQ ID NO: 357008 - DNA, 752 bp, Homo sapiens
  misc_feature: GZ8MTXP02JSYCQ.22.36.D03.1.454.CMB.2.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaanagtgactagttgggtcttttgactctgtctcctgtaaccaacaaccacccacgaccccaaacccccatcatctatttatggtctctactcgtccgccctgaggtacgtctccctctacgtccgtcctttcaccgacggtccctaccgtaacggttccgtacgggaccctaaacccgacccgggtcccccttaaccccctaaaccctcttcccgtccggtcgggtcccttacccgtaggtttacggaacggtaccgtacgtttacctttaactttacgtttaccgtacgtacgtttaacgttttaacccgttttaaaagttcggacccgtacccttaaccgtttccggtttacggggttttccggggtttaccggggaccgggtaacgggtacccgtaaacccgggttaaacgggttcccggtaacccccggttcccggtaccgggttaccgaaccggaacccggtaacggtcccgttaccccggtccccccgtttcgggtaccctaccgtttcccccg

SEQ ID NO: 357009 - DNA, 594 bp, Homo sapiens
  misc_feature: GZ8MTXP02ICUNW.22.36.D03.1.454.CMB.2.raw
  modified_base (222)..(222): a, c, t, g, unknown or other
  misc_feature (222)..(222): n is a, c, g, or t
  modified_base (255)..(255): a, c, t, g, unknown or other
  misc_feature (255)..(255): n is a, c, g, or t
  modified_base (329)..(329): a, c, t, g, unknown or other
  misc_feature (329)..(329): n is a, c, g, or t
  modified_base (402)..(402): a, c, t, g, unknown or other
  misc_feature (402)..(402): n is a, c, g, or t
  modified_base (441)..(441): a, c, t, g, unknown or other
  misc_feature (441)..(441): n is a, c, g, or t
  modified_base (470)..(470): a, c, t, g, unknown or other
  misc_feature (470)..(470): n is a, c, g, or t
  modified_base (593)..(593): a, c, t, g, unknown or other
  misc_feature (593)..(593): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgaggggaaggggttgcaggtgggtctcggggattggaagtgatgggtgccacacactacgcagactccgtggaggggccnttcatcatctccagagacgattaccgaaaaacncagtagaatctgacaaatgtacagcctcagccgccgagaccacggccgtctacttctgtgacgaaagacccttnttagtttttcggggcccgtcggaccgtaccgtacgtcggggccgaggggccacccgtgtccaccgtctcttcncgcctccaccaacgggcccagtcccggtccttcccccgngggccctccccgtgccctccgacgggacnccgaccctccgacgcgccacgcggcccggcccgtgggcctcgccgtcggtacaacggtacctacgttccacggtcgtaacgtcgtcgttaggacggccggcgtcgggacaacgggccgcaagng

SEQ ID NO: 357010 - DNA, 584 bp, Homo sapiens
  misc_feature: GZ8MTXP02GBHYN.22.36.D03.1.454.CMB.2.raw
  modified_base (217)..(217): a, c, t, g, unknown or other
  misc_feature (217)..(217): n is a, c, g, or t
  modified_base (250)..(250): a, c, t, g, unknown or other
  misc_feature (250)..(250): n is a, c, g, or t
  modified_base (442)..(442): a, c, t, g, unknown or other
  misc_feature (442)..(442): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattaccgaaaacncagtgaatctgacaaatgtacagcctcagcgccgaggacacggccgtctacttctgtgacgaaagacctcttagtttttcgggccgcggccgacctacgtcggggccagggccacccgtggtccaccgtctcttcacgcctccaccaacgggcccatccggtccttccccgtgcccgccctgcctccaggcnccacctccgacgacgccacgacgcccggccgtgggcctcggccgtcgggtacaacgggaccttaccgttacccacggtcgttaacgtcgttccgtggacgggccggggtcgttacgggaccgaacgggcgaccgaagtacgg

SEQ ID NO: 357011 - DNA, 668 bp, Homo sapiens
  misc_feature: GZ8MTXP02JSX7R.22.36.D03.1.454.CMB.2.raw
  modified_base (304)..(304): a, c, t, g, unknown or other
  misc_feature (304)..(304): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctgacactctcctgtgcagcctctggattcacagtcagcagcaatgccatgagttgggtccncaggcctccgaggggaggggttgcgaggtgggtcgtcggggattggggaaagtgaggtggtcgacacactacgacgcgaacgtccgtcggtacggggacggggtccctccgttacgactcctacttccctacgaaggaacgtacgtaccgtaaacccgaaacacgtagtaacgtaactcgtagaaacctaagttaccgaacgacctaccctacggaacggcccggacggaacggacccggaccgggtccttaccgttacttcggtcgtaacggaaccgtaaacgtccctttagtttacgggtttcccgggacccgggtacccggtccggtaaccgttccggggaccggggtaccgaacccgggg

SEQ ID NO: 357012 - DNA, 615 bp, Homo sapiens
  misc_feature: GZ8MTXP02IVPSB.22.36.D03.1.454.CMB.2.raw
  modified_base (300)..(300): a, c, t, g, unknown or other
  misc_feature (300)..(300): n is a, c, g, or t
  modified_base (322)..(322): a, c, t, g, unknown or other
  misc_feature (322)..(322): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtcctgacactctcctgtgcagcctctggattcacagtcagcagcaatcgccatgagttggccncaggctccgaggggaggggttncgtaggtgggtctcggggattgggaagtgagtggtgccacacaccgtacgcagacctccggagacgggggccctacttcacgtcactctaccagaacgacgtacttaaccgaaaacaacgtaagtacgaactacgtacgaactaaagtacgtacgacgcctacgacggcgaccggacggaccgaccggtacccgtacttacgttcgtcgtacgacgtaaacgtaccgttacgtttaacgttttcgggacccggtaccggtacccgtaccgtacggtacggggaccgtaccggg

SEQ ID NO: 357013 - DNA, 592 bp, Homo sapiens
  misc_feature: GZ8MTXP02H7112.22.36.D03.1.454.CMB.2.raw
  modified_base (216)..(216): a, c, t, g, unknown or other
  misc_feature (216)..(216): n is a, c, g, or t
  modified_base (230)..(230): a, c, t, g, unknown or other
  misc_feature (230)..(230): n is a, c, g, or t
  modified_base (302)..(302): a, c, t, g, unknown or other
  misc_feature (302)..(302): n is a, c, g, or t
  modified_base (318)..(318): a, c, t, g, unknown or other
  misc_feature (318)..(318): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagcatttccngcactgggaccaanagtgacagttgggttctttgactctgtctctgtaccaacaacaccagaccaaacccccatcatcattatgtntcactcgtcggcctcnggtagtctctccatcgcttctcacggtctccaagtctgaccaacacggcctaccctaaccactcctcgtcgggctcccgtagtttgacggtacgacgttcttaacttattacgtgtacttacgtttaccttaaagttcgcgtacctacttccgtcggtttcggttttccggcggtacggtaccaccggtaaaggtccgtaacccggttcctacgggtcctacggacccgaagggtccctacggccccccgtcggtccctaccgttcgttccccg

SEQ ID NO: 357014 - DNA, 539 bp, Homo sapiens
  misc_feature: GZ8MTXP02IPAJ0.22.36.D03.1.454.CMB.2.raw
  modified_base (531)..(531): a, c, t, g, unknown or other
  misc_feature (531)..(531): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccagccaaaccccccatcatcatttatggtgtcactcgtcggccctcaggagtctcctcatcgcttctcaggctcaagtctgccaacacgcctcctaccatctctggctcagtttgaggacgagtcttattattctgctagtttcctttaaaagtgcgtactacgtcttcgttcggttttcggcggttaaggcctacggaaacgtcggacccgttccgtcgtacacgcccgaaggcctccgcccctccggtacnctttcccg

SEQ ID NO: 357015 - DNA, 538 bp, Homo sapiens
  misc_feature: GZ8MTXP02G513X.22.36.D03.1.454.CMB.2.raw
  modified_base (304)..(304): a, c, t, g, unknown or other
  misc_feature (304)..(304): n is a, c, g, or t
  modified_base (360)..(360): a, c, t, g, unknown or other
  misc_feature (360)..(360): n is a, c, g, or t
  modified_base (377)..(377): a, c, t, g, unknown or other
  misc_feature (377)..(377): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctgtaccaacaacacccagccaaacccccactcatcattatgtntcactcgtcggccctcagacgtctcctcatcgcttctcagctccaagtctgcaacncgcctaccctaacatcnctggctcagttgagtacagtctacttattactgctagtttactttaaattacggccgtaccactcgttcggttcggttttcggcgggtaacggcaaccggtaacgtcggaaccgtccgtacggtcgacgcccgaaggcctcgccccgtcggtcctactccg

SEQ ID NO: 357016 - DNA, 655 bp, Homo sapiens
  misc_feature: GZ8MTXP02F469Q.22.36.D03.1.454.CMB.2.raw
  modified_base (276)..(276): a, c, t, g, unknown or other
  misc_feature (276)..(276): n is a, c, g, or t
  modified_base (303)..(303): a, c, t, g, unknown or other
  misc_feature (303)..(303): n is a, c, g, or t
  modified_base (306)..(306): a, c, t, g, unknown or other
  misc_feature (306)..(306): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacncccacgccaaacccccatcatcattangtntcactcgtcgccctcaggagtctcctcactcgcttctcacggtctccaaagtctggacctaacgaccgtccctaccctaacctactctcgtgggtcctccgtagtttgaacggtacgtacgttcttaacgtttaactttactcggtactaagtttaccctttaaagttacggcctacctacgttccgttacggttcgggttttacgggacggtacgggacccgtaaccggtaaacggttaccggtaacccggttcccgttaccggggtaccctaccgggtaacccccgttaaaacgggcccgttaccgggtacccccccgttacggtccccgttaaccgtttcccccgg

SEQ ID NO: 357017 - DNA, 596 bp, Homo sapiens
  misc_feature: GZ8MTXP02JTYEK.22.36.D03.1.454.CMB.2.raw
  modified_base (309)..(309): a, c, t, g, unknown or other
  misc_feature (309)..(309): n is a, c, g, or t
  modified_base (370)..(370): a, c, t, g, unknown or other
  misc_feature (370)..(370): n is a, c, g, or t
  modified_base (447)..(447): a, c, t, g, unknown or other
  misc_feature (447)..(447): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggcttggtacgaggccggggggtccctgacactctcctgtgcagcctctggattcacagtcagcagcaatgccatgagttggccncaggctccgaggggaagggttgcgagtgggtcgtcggggattgggaagtgagtggtcgccncgacacgtaccgcagtacctccggtgggacggggcccgcttcacgtcactctaccagagaccgacttaccgaaaacncaagtgaatctagactaaagtcgtaacacgcctacgacgccggaccgaacggaccgccgggtaccgtaccttacgttccgtaggttcgaaccgaaaacgtacccgttacgtttacggttttcggggcccggtaccggacccgtaaccgg

SEQ ID NO: 357018 - DNA, 640 bp, Homo sapiens
  misc_feature: GZ8MTXP02HNOAI.22.36.D03.1.454.CMB.2.raw
  modified_base (296)..(296): a, c, t, g, unknown or other
  misc_feature (296)..(296): n is a, c, g, or t
  modified_base (308)..(308): a, c, t, g, unknown or other
  misc_feature (308)..(308): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaaccaacagtgactattgggtctttgactctgtctctgtaccaacaacacccagaccaaaccccccancatcattatgtntcactcgtccggccctcgaggagtctcctacatcgtcttactcaggtcctccaagtctcggacaacgaccggccctacccctaaccacttccctcgtcggggtcccttacccgtaggtttacggaacgggtacgtacgttaccttaacgtttactttacgtacggtaccttaacgtttaacccttttaaaagttacgggacccgtaccctaaccgttccgttcggtttcgggttttccggacggtacggtcgaccggtaacgttccgaccgttcccgtcgtaccgacgtccccgaaggtcccgtccgtcccccgtcggcctaccgtttcccg

SEQ ID NO: 357019 - DNA, 643 bp, Homo sapiens
  misc_feature: GZ8MTXP02H1TW7.22.36.D03.1.454.CMB.2.raw
  modified_base (308)..(308): a, c, t, g, unknown or other
  misc_feature (308)..(308): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcttgggtacaggccggggggtccctgacactctcctgtgcagccctctggattcacagtcagcagcaatgcatgagttggccncaggctcgagggagggttgcgagtggtcgtcggggattgggaagtgagtggtcgccacacactacgcaagaccgtccgtaggacggggcccgcttcgactcgaactcctaccacgaacgaaccgtacgttaaacccgaaaacaaccgtaacggtagtaaatactacggacctaaaagttacgaacacggacctaccgacgccggaacccgacgggaaaccgaccgggacccgttaccgttaccgttaccgtaggttaccggaacggtaaaaccgtacccgttacgtttaacggtttttcggggaccccggtacccgggttacccggtaaacccgg

SEQ ID NO: 357020 - DNA, 635 bp, Homo sapiens
  misc_feature: GZ8MTXP02F3PX1.22.36.D03.1.454.CMB.2.raw
  modified_base (303)..(303): a, c, t, g, unknown or other
  misc_feature (303)..(303): n is a, c, g, or t
  modified_base (398)..(398): a, c, t, g, unknown or other
  misc_feature (398)..(398): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccgggggggtccctgacactctcctgtgcagcctctggattcacagtcagcagcaatgccatgagttgggtccncaggctccgaggggagggttgcaggtgggtcgtcggggattgggaagtgagtggtcgccacacacctacgcagacctccggtggacgggggcccncttcatcactcctaccgagacgacgacttacccgaaaactacagtagaaactctagactaaatcgtaacaacgccctacgacggcgaccggacggaccgaccgggtcccgttacttacctttcgtacggttacgaaccggtaaaacgtacccgttacgtttaacggtttttccgggggccccgtaccggggtaccccggtaaccgttaccgggtacgggggaccccgtaaccggggg

SEQ ID NO: 357021 - DNA, 603 bp, Homo sapiens
  misc_feature: GZ8MTXP02HPJEV.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttggtccgccaggctccgaggggaaggggttgcgtaggtgggtcgtcggggatttgggaagtgagtgggtgcccaacacaccgtacgcgaacggtacctccggtaggacggggggcccctctttcgacttccaacttcctcccgaagaacgtaaccgaacttacccgaaaaacaccaagtacgaaatctagactaaatgtacagcctcaagccgccgaggaccgacggcctctacttcgtcgtcgacgtaacgtaccttcgttacgttttcgggacccgccggccgacgtaccgcggggtaccgaccggg

SEQ ID NO: 357022 - DNA, 552 bp, Homo sapiens
  misc_feature: GZ8MTXP02HVKZB.22.36.D03.1.454.CMB.2.raw
  modified_base (321)..(321): a, c, t, g, unknown or other
  misc_feature (321)..(321): n is a, c, g, or t
  modified_base (355)..(355): a, c, t, g, unknown or other
  misc_feature (355)..(355): n is a, c, g, or t
  modified_base (373)..(373): a, c, t, g, unknown or other
  misc_feature (373)..(373): n is a, c, g, or t
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
  modified_base (387)..(387): a, c, t, g, unknown or other
  misc_feature (387)..(387): n is a, c, g, or t
  modified_base (389)..(389): a, c, t, g, unknown or other
  misc_feature (389)..(389): n is a, c, g, or t
  modified_base (424)..(424): a, c, t, g, unknown or other
  misc_feature (424)..(424): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggagcttggtacaggccgggggggtccctgacactctcctgtgcagcctctggattcacagtcagcagcaatgccatgagttggccgcaggctccgagggaagggtncagtgggtctggggattggaagtgatggcgccanacactagcagactccggngnggcgctcancancncagagacgaactaacgaaacaacagtagaatatanacaaatagtacacgacacgacgacgacgacgacgacgaccgtacctacttctcgtacgacgaaacgtaccttacgttacgtttaacggtccggaccggaccggaccgtaccggtacgggaccggacgg

SEQ ID NO: 357023 - DNA, 554 bp, Homo sapiens
  misc_feature: GZ8MTXP02JDAWG.22.36.D03.1.454.CMB.2.raw
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggagcttggtacaggccggggggtccctgacactctcctgttcagccctctggattcacagtcagcagcaatgccatgagttggtccgcaggctccgaggggaagggttgcgaggtgggtctcggggtatgggaagtgatgggtnccgancactacgcagactcgtggacgggccgcttcgatcactctcagagacgaattacccgaaaactacagtagaatctagcaaatgtacagctcagcgaccgaggacacggccgtctacgttctcgtacgaccgtaaacgtaacccgttcgttaacgttttcggggaccgtccggtaccgtacgtaccgg

SEQ ID NO: 357024 - DNA, 661 bp, Homo sapiens
  misc_feature: GZ8MTXP02FVTNM.22.36.D03.1.454.CMB.2.raw
  modified_base (314)..(314): a, c, t, g, unknown or other
  misc_feature (314)..(314): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcgttgggtacgaggcccggggggtccctggacactctcctgtgcagccctctggattcacagtcagcagcaatgccatgagttcggccncaggctcgaggggaggggttgcgaggtggtcgtcggggattgggaagtgagtggtcgcccacgaccacgtacgcaagtactcccgggtagggacggggcccgtcgttcgacttcgactcctaccgagaacgaacgtacttaacccggaaaaacctaccaaaggtagtaactaccgtagtactaaacgtacgtaacacgcctaccgacggccggacccggaacggaccgtaaccggtcccgttaccgttaccgtttaccgtacggttacggtaaccggtaaaaccgtaacccgtttaccgtttaacggtttttaccggggaccccggtccgggtacccggtaacccgg

SEQ ID NO: 357025 - DNA, 556 bp, Homo sapiens
  misc_feature: GZ8MTXP02I0MKQ.22.36.D03.1.454.CMB.2.raw
  modified_base (312)..(312): a, c, t, g, unknown or other
  misc_feature (312)..(312): n is a, c, g, or t
  modified_base (371)..(371): a, c, t, g, unknown or other
  misc_feature (371)..(371): n is a, c, g, or t
  modified_base (440)..(440): a, c, t, g, unknown or other
  misc_feature (440)..(440): n is a, c, g, or t
  modified_base (460)..(460): a, c, t, g, unknown or other
  misc_feature (460)..(460): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcttggtacgaggcccgggggggtccctggacactctcctgtgcagcctctggattcacagtcagcagcaatgccatgagttggtccnccaggctccgagggaggggttgcgagtgggctcggggattgggaagtggagtggtgccnacactacgcagctcggtggacggggccgtcttcactcatctccagagacgacttaccgaaaacacagtnaatctagacaaagtgtaacngacctcacgcgccgacggacacggtccgtctacgttcgtacgtcgacgaaacgtaccctacgttacgttttcgggacccgtcggtaccgtaaccgg

SEQ ID NO: 357026 - DNA, 672 bp, Homo sapiens
  misc_feature: GZ8MTXP02IYSSG.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggagcttggtacgaggccggggggtcctgacactctctgtgcagcctctggattcacagtcagcagcaatcgaccagtgaggttcgggtcccgcgacggcctaccggaaggggtaggggttcgcgtagggtcgggtcggtacggggtagttgggaaagtgagtgggtcgccaacgagaccgtacgcgacgaccgtccggtaggacgggggcctcttcagtccatcctacgagacgaacgtacttaaccgaaaacaacgagtagtaactacgtacgaacgtaaacgttacggaacaccgtccgaccgaacgggaccggaccggaacggtaaaccggccgggtacccgtttaccttacgtttcgtacggttaacggaacgtaaaccgtaaccttcgttttaacggtttcggggacccgtaccgggtaccgtacgtacggtccgggggaccgtaaccgggg

SEQ ID NO: 357027 - DNA, 570 bp, Homo sapiens
  misc_feature: GZ8MTXP02GB9YI.22.36.D03.1.454.CMB.2.raw
  modified_base (385)..(385): a, c, t, g, unknown or other
  misc_feature (385)..(385): n is a, c, g, or t
  modified_base (396)..(396): a, c, t, g, unknown or other
  misc_feature (396)..(396): n is a, c, g, or t
  modified_base (507)..(507): a, c, t, g, unknown or other
  misc_feature (507)..(507): n is a, c, g, or t
  modified_base (522)..(522): a, c, t, g, unknown or other
  misc_feature (522)..(522): n is a, c, g, or t
tcagacatacgcgtcacgaccggtgctcgatttagctgcgtcacgatctctcttgggggagagaggagcccagccctgcgattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggagcttggtacagggccggggggtccctgacactctcctgtgcagcctctggattcacagtcagcagcaatgccatgagttgggccgccgaggctccgaggggaggggttgcgaggtggggtcgtcggggattgggaagtgagtggtgccacacactacgcagactccgngacgggggccncttcatcactctccagacgacgaactaaccgaaaacacaagtagaaactctacgacaaatagtaacacgcctacgacgccgccgaaggaccgaccggccgtactaccttcngtacgacgtaaaacnccttacttaacgtttcggccgccggccgtaccgtacgtcgggacccgg

SEQ ID NO: 357028 - DNA, 678 bp, Homo sapiens
  misc_feature: GZ8MTXP02JOBJO.22.36.D03.1.454.CMB.2.raw
  modified_base (309)..(309): a, c, t, g, unknown or other
  misc_feature (309)..(309): n is a, c, g, or t
  modified_base (386)..(386): a, c, t, g, unknown or other
  misc_feature (386)..(386): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtacaagtgtgcggtgaaggtattggagtcgtgggggaggcttgggtacagggccggggggtccctgacactctcctgtgcagcctctggatcacagtcagcagcaatcgaccatgagtttcgggtcccncgacggcctcggaaggggtacgggttgcgtagggtcgggtcgtcggggtagttgggaagtgagtggtgccacacacncgcacggactcggtcggacgggggcctcttcgactctaactcctacgacgtaacgaccgtaacgttaaccgaaaacgacgaacgtacgaaacttccgtaaggaactaaaacgttacggtaaccaacgaccgcgaaacggccggaccggacggaccgaacccggtccgttaccgtaccgttcgtcggtaacggtaaccgtaaacgtacccgttacgtttaaccggttttccggggccccggttaccggggaccccgtaacgttacccgggccgggggacccgtaacccggggg

SEQ ID NO: 357029 - DNA, 568 bp, Homo sapiens
  misc_feature: GZ8MTXP02FHAN8.22.36.D03.1.454.CMB.2.raw
  modified_base (329)..(329): a, c, t, g, unknown or other
  misc_feature (329)..(329): n is a, c, g, or t
  modified_base (395)..(395): a, c, t, g, unknown or other
  misc_feature (395)..(395): n is a, c, g, or t
  modified_base (429)..(429): a, c, t, g, unknown or other
  misc_feature (429)..(429): n is a, c, g, or t
  modified_base (459)..(459): a, c, t, g, unknown or other
  misc_feature (459)..(459): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggcccgggggggtccctgacactctcctgtgcagcctctggattcacagtcagcagcaatgccatgagttgggtccgccaggctccgaggggaaggggttncgagtggggtctcggggattggaagtgatggtgccacacactacgcagacctccggtgaggggccncttcatcatctaccagagacgattaccgaaaacncagagaatctagcaaaatgtacagccctanacgcgccgagacacggcccgtctaccttctgtcgacgaaaacgtacctctttaagttttcggggacccgtccgggacccgacgtttaccggcgggggcccgtaacgggg

SEQ ID NO: 357030 - DNA, 514 bp, Homo sapiens
  misc_feature: GZ8MTXP02FQ2DF.22.36.D03.1.454.CMB.2.raw
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
  modified_base (360)..(360): a, c, t, g, unknown or other
  misc_feature (360)..(360): n is a, c, g, or t
  modified_base (375)..(375): a, c, t, g, unknown or other
  misc_feature (375)..(375): n is a, c, g, or t
  modified_base (431)..(431): a, c, t, g, unknown or other
  misc_feature (431)..(431): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacaccagcaaacccccatcatcattangtgtcactcgtcggccctcaggagtctcctcatcgcttcncaggctccaagtctgcaacncgcctcccaacatcnctggctccagtttgaggacagtctacttatactgctagtttacctttaaatcggcncactctcgttggtttcggcggtacgcacgaagtcgaccgttctacggtcacgcccgtaagcctcgcccctcggtccacttccg

SEQ ID NO: 357031 - DNA, 581 bp, Homo sapiens
  misc_feature: GZ8MTXP02FSPO8.22.36.D03.1.454.CMB.2.raw
  modified_base (301)..(301): a, c, t, g, unknown or other
  misc_feature (301)..(301): n is a, c, g, or t
  modified_base (401)..(401): a, c, t, g, unknown or other
  misc_feature (401)..(401): n is a, c, g, or t
  modified_base (437)..(437): a, c, t, g, unknown or other
  misc_feature (437)..(437): n is a, c, g, or t
  modified_base (450)..(450): a, c, t, g, unknown or other
  misc_feature (450)..(450): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccgggggggtccctgacactctcctgtgcagcctctggattcacagtcagcagcaatgccatgagttggccnccgaggctccgaggggaaggggttgcgaggtgggtcgtcggggattgggaaagttgacgtggtgccaacacactacgcagacctccggtgacgggggccncttcgatcattcaccagagacgacttaccgaaaacncagtagaaattcngaacaaatgtaacagccctagacgcgaccggagaccgacgggccctactacgttcgtgtcgaacgtaaaacgcccttgtttaacgtttcgggcccgcggtacccgacgttaccggcggggacccgacgggg

SEQ ID NO: 357032 - DNA, 667 bp, Homo sapiens
  misc_feature: GZ8MTXP02HWTFN.22.36.D03.1.454.CMB.2.raw
  modified_base (376)..(376): a, c, t, g, unknown or other
  misc_feature (376)..(376): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaatttttaaaaggtgtcaagtgtgcggtgaaggtatggagtcgtgggggaggcttgggtacagggccgggggggtccctggacactctccgtgtgcagcctctggattcacagtcagcagcaatcgccatgaggttgggccgccgaggctccgaggggaggggttgcgaggtcgggtctggggattgggaaagtgacgtgggtcgccanacgactacgcagtacctcccgggtggacggggcccgtcttcaatcacttccaccgaacggacgacgtaacttaacccggaaaaacaccaggttagaaactctacgactaaaattcgaacgacgcctacacggaccgaccggaacggacccgaaccgggcccgttacctacgtttccgtacggttacggaaccgtaaaacggttacccttacggtttaacggtttttccgggggaccccggtccgggtaccccgtaacgttaacccgggttcgggggaccccgaaccggggg

SEQ ID NO: 357033 - DNA, 529 bp, Homo sapiens
  misc_feature: GZ8MTXP02I8C9H.22.36.D03.1.454.CMB.2.raw
  modified_base (324)..(324): a, c, t, g, unknown or other
  misc_feature (324)..(324): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggagcttggtacgaggccggggggtccctgacactctcctgtgcagcctctggattcacagtcagcagcaatgccatgagttggccgcaggctccgagggagggtncgagtggctcggggattggaagtgagtggtcnccanacactacgcagactccgtgacgggccgctcatcatctccagacgacgataccgaaaacacagtagaatctagacaaatgtacagctcagcgacgacggacacggccgtcgtacttcgtacgtcgacgtaaacgtcctacgttacgtttcgggccgtcggtaccgtaacg

SEQ ID NO: 357034 - DNA, 633 bp, Homo sapiens
  misc_feature: GZ8MTXP02FZUPJ.22.36.D03.1.454.CMB.2.raw
  modified_base (454)..(454): a, c, t, g, unknown or other
  misc_feature (454)..(454): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacgaggccgggggggtccctggacactctcctgtgcagcctctggattcacagtcagcagcaatgccagtgagttgggtcccgcgaggcctccgaggggaaggggttgcgaggtcgggtcgtcggggattggaagtgagtggtcgccacgacacgtacgcaagacctccggtaggacgggggccctcgttcatcacttccaccgagacgacgacttaacccggaaaacncaagtagtaaactctagaccaaatcggtaacacgtccctacgacgccgaccggacggaccgtcccgggtccgttactacgtttacgtcgttacggaacgtaaaaccgttaccttcgtttaacgttttccggggcccgtaccggtacccgtacgtaccggtacggggcccgtaaccgggg

SEQ ID NO: 357035 - DNA, 752 bp, Homo sapiens
  misc_feature: GZ8MTXP02GSBVQ.22.36.D03.1.454.CMB.2.raw
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggagcttggcagacggggccgggtcncgacactctcgtgtcncgacgtcctcggtgtacttaccagtacgacgacgacgacgaactaagtcggacctagtaacgggttaggggtttccggggtaccccacggtaacggtccccgtaccggggaaaggggggtttaacgggggttcgaccggttaggggttcggggttccggggttacggggtagggttagggtaaggtcgtaagggttggaccgcccaaacacgtaaccgacgacgaacgtacccgtccgggtaggggcggggtccccttcttacacgtacctacttccccgtaacgaacggtaaacggaacgttaaccttaaaaccccggaaaaaccagttacggaagtaaaccttcgggtaaacgaaacctaaaaggttcggtaaacccgcgtaccacggacgaccggacggaccggtaccggaccgttcctacttacgtcgtacggacgtaaaccgtaaccgttcgtttacggtttacgggtccggcccggtaccgtaccg

SEQ ID NO: 357036 - DNA, 569 bp, Homo sapiens
  misc_feature: GZ8MTXP02G2GFY.22.36.D03.1.454.CMB.2.raw
  modified_base (342)..(342): a, c, t, g, unknown or other
  misc_feature (342)..(342): n is a, c, g, or t
  modified_base (361)..(361): a, c, t, g, unknown or other
  misc_feature (361)..(361): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggacccaacagtgacattgggtcttttgactctgtctcctgtactaacaacaccagaccaaaccccccatcatcatttatgtgtcactcgtcgccctcaggatctcctcatcgcttcncaggctcaagtctgcaacncgccctacccaacatctctggcctcagtttcgaggacgagtcttattattactgtctagtttaccctttaaattacggcgtacccgtacttcgtccgtttcgggttttaccggcggttacggaccgtaaccgaacggttcgtaacccgtccgtacggtccacggcccctaaaggccttaccggcccccttcggtacctaccgtttccg

SEQ ID NO: 357037 - DNA, 563 bp, Homo sapiens
  misc_feature: GZ8MTXP02GUNG8.22.36.D03.1.454.CMB.2.raw
  modified_base (306)..(306): a, c, t, g, unknown or other
  misc_feature (306)..(306): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgttcagcctctggattcacagtcagcagcaatgccatgagttgggccncaggctccgaggggaaggggttgcgaggtgggtcgtcgggggattggggaagtgagtgggtgcccacacactacgcagacctccggtggacggggccgctcgatcactctccagacgacgacttaccgaaaacacagtagaactctagacaaatcgtaacacgcctacacgcgaccgacggacgaccggccgtctacttcgtcgtacgacgaaacgaaccgttcgttaacgttttcggccgtcggccgacgtaccgg

SEQ ID NO: 357038 - DNA, 570 bp, Homo sapiens
  misc_feature: GZ8MTXP02JPUHP.22.36.D03.1.454.CMB.2.raw
  modified_base (326)..(326): a, c, t, g, unknown or other
  misc_feature (326)..(326): n is a, c, g, or t
  modified_base (353)..(353): a, c, t, g, unknown or other
  misc_feature (353)..(353): n is a, c, g, or t
  modified_base (357)..(357): a, c, t, g, unknown or other
  misc_feature (357)..(357): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttgggtacaggcccggggggtccctgacactctcctgtgcagcctctggattcacagtcagcagcaatgccatgagttggccgccaggctcgagggagggtncgagtggctggggattggagtgatggngcanacactacgcagactccggtagacggggcctacgttcactctatcctaccgagaacgaaccgtaacgttacccgaaaaactcaaggtagaatcctagactaaaatcgtaacacgcctcgaagccgacccggaagacccgaccgggcctactaccttcgagtacgaccgaaaacgtccctagtttacggtttcgggcccgtacggtccgtaaccg

SEQ ID NO: 357039 - DNA, 583 bp, Homo sapiens
  misc_feature: GZ8MTXP02HSEHY.22.36.D03.1.454.CMB.2.raw
  modified_base (402)..(402): a, c, t, g, unknown or other
  misc_feature (402)..(402): n is a, c, g, or t
  modified_base (440)..(440): a, c, t, g, unknown or other
  misc_feature (440)..(440): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccggggggtccctgacactctcctgtgcagcctctggattcacagtcagcagcaatgccatgagttcggccgccaggctccgaggggtaaggggttgcgaggtgggtcgtcggggtattgggaagtgagtggtcgccacacactacgcagacctcgtggacggggccncttcatcattcctccagacgacgtacttaccgaaaacncagtagaatctagaccaaagtcgtaacagtccctacacggccgacccggaaggacccaccgggtcccgtcttaccgttcgtcgtacgacgtaaaacgtccttacgtttacggtttccgggcccgtacgggtacccgtaaccgg

SEQ ID NO: 357040 - DNA, 619 bp, Homo sapiens
  misc_feature: GZ8MTXP02FOYP5.22.36.D03.1.454.CMB.2.raw
  modified_base (356)..(356): a, c, t, g, unknown or other
  misc_feature (356)..(356): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttgggtccgcaggctccgaggggaggggtgcgaggtgggtcgtcggggattggaagtgatggngccacacactacgcagacctccggtggacgggggcctcttacactcactctacccgagaacgacgacgttaacccgaaaacacgaagtacgaaatcgtagaacaaatacgtaacacgtccctacgacgaccggaccggaaggaccgaccgggcccgtaccgttaccttcgttcgacggtaccgaaaacggtaaccctcgtttaacggttttcggggccccgtcgggaccggtaccgtaccggtcgggggacccgaaccggggg

SEQ ID NO: 357041 - DNA, 651 bp, Homo sapiens
  misc_feature: GZ8MTXP02JL4UK.22.36.D03.1.454.CMB.2.raw
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (343)..(343): a, c, t, g, unknown or other
  misc_feature (343)..(343): n is a, c, g, or t
  modified_base (380)..(380): a, c, t, g, unknown or other
  misc_feature (380)..(380): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaccaacagtgacagttgggtcttttgactctgtctcctggtaccacaacaccagaccaaacccccancatcatttangtntcactcgtccgccctgaggatctcctcatcgcttcncaggctccaagtctggacaacgccgccctacccaacnctctcgtggcctcgtagtttgacggacgtagtcttacttattactgtactacgtttacctttaaaagttcggacctacctcgttccgtttaccgggtttcgggttttaccgggacgggttacggacccgtaaaccgggtaaaacggtcccggtaaacccgggttcccgtttacgggggtaacccaaccgggttaaccccgaaaaccggggttccccgtaaccccggttccccccccgtttaacgggttcccccaacccgtttttcccccgg

SEQ ID NO: 357042 - DNA, 620 bp, Homo sapiens
  misc_feature: GZ8MTXP02G771D.22.36.D03.1.454.CMB.2.raw
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatgccagtgagttgggccncgaggctccgaggggagggttncgagtggggctcggggattggaagtgactggtgccacgacaccgtacgcagaccgtccggtaggacggggtccgctttcactccactccgtacccgaaggaacgaaccgtaacttaacccggaaaaactaccgaacgtagtaaactcgtacgactaaagtgtaccgacgccctacgacgccgaccggaggaccaccggtccgtacctacgttctagtccggaactaaacggtacccttcgtttacgtttccgggccgtccggtacccgtacggtaccggtcggggacccgaaccggg

SEQ ID NO: 357043 - DNA, 631 bp, Homo sapiens
  misc_feature: GZ8MTXP02F6DAS.22.36.D03.1.454.CMB.2.raw
  modified_base (301)..(301): a, c, t, g, unknown or other
  misc_feature (301)..(301): n is a, c, g, or t
  modified_base (307)..(307): a, c, t, g, unknown or other
  misc_feature (307)..(307): n is a, c, g, or t
  modified_base (385)..(385): a, c, t, g, unknown or other
  misc_feature (385)..(385): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccgggggggtcctgacactctcctgtgcagcctctggattcacagtcagcagcaatgccatgagttggccncgagcncgaggggagggtgcgagtgggtcgtcggggattgggaaagtgagtggtcgccacacacgtcgcacgacttaccggggnggacgggtcctctcactcactccacgagaacgaacgtaactaaaccgaaaacacgtagtacgtaaactcgtaacgaactaaaagtacgtaacacgacccgtacgacggccggaccggaacggaccgtaccggtaccgttacttacgttcgtacggtacgaaaccgtaaacgtacccgtttacgtttaacggtttccggggcccggtaccgggtacccgtacggtaccgggacggggacccgacggg

SEQ ID NO: 357044 - DNA, 573 bp, Homo sapiens
  misc_feature: GZ8MTXP02JNG2N.22.36.D03.1.454.CMB.2.raw
  modified_base (303)..(303): a, c, t, g, unknown or other
  misc_feature (303)..(303): n is a, c, g, or t
  modified_base (396)..(396): a, c, t, g, unknown or other
  misc_feature (396)..(396): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccggggggtccctgacactctcctgtgcagcctctggattcacagtcagcagcaatgccatgagttgggtccncaggctccgaggggaggggttgcgaggtggggtctcggggattggggaagtgatgggtgcctacacactacgcagactccgtgacgggggccncttcatcagtctcccagacgacgacttaccgaaaacacagtcaaatctagaccaaagtgtaccgagacctacagaccggccgaggaccacggccgtctacgttccgtagcgacgaaacgtaccctcttagttttcggggccgtaccggccgaccgttacgtcggggaccgaccgggg

SEQ ID NO: 357045 - DNA, 740 bp, Homo sapiens
  misc_feature: GZ8MTXP02GH8V9.22.36.D03.1.454.CMB.2.raw
  modified_base (303)..(303): a, c, t, g, unknown or other
  misc_feature (303)..(303): n is a, c, g, or t
  modified_base (344)..(344): a, c, t, g, unknown or other
  misc_feature (344)..(344): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctctggtaccaacaacacccagccaaacccccaatcatcatttanggtgtcactcgtcggccctcaggagtctcctcatcgcttcncagctccaagtctacgcaaacaccggtccctaccctaaaccactcctcgtcgggtccttacccgtaggttttacggaacgggtaccgtaacggttacctttaaacgtttaactttaaaccgttaggtacccgttaacggtttttaaaccccgtttttaaaaagtttaaccggggtcccgtaccccttaaacccgttcccgtttaaccgggtttccggggttttttaccggggaccgggttaaacggggcccgtaaaacccgggtaaacggttaccgggtaaaccccggtttccccgttaaaccggggttcccgtaaaccggaacccccgtaaaacgggtccccgttacccgggtacccccccgtttaccggggttcccctaaccgttttcccccgg

SEQ ID NO: 357046 - DNA, 554 bp, Homo sapiens
  misc_feature: GZ8MTXP02IWYTR.22.36.D03.1.454.CMB.2.raw
  modified_base (216)..(216): a, c, t, g, unknown or other
  misc_feature (216)..(216): n is a, c, g, or t
  modified_base (304)..(304): a, c, t, g, unknown or other
  misc_feature (304)..(304): n is a, c, g, or t
  modified_base (373)..(373): a, c, t, g, unknown or other
  misc_feature (373)..(373): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctctggtaccaacaacacccagccaaaccccccatcatcatttatgtntcactcgtcggccctcagagtctctccatcgcttctcaggctcagtctgcaacgacgcctccctaaacntctctggctccagttcgagacgagtctacttattactgtactagtttcctttaaagtgccgtccacttcgtcggttcggttttcggcggtacggacaccggtaaagtcggtaaccgttccgttacggtcacgtacccgaacggccgtccggcccccgttcggtccaccgttcctttacccg

SEQ ID NO: 357047 - DNA, 558 bp, Homo sapiens
  misc_feature: GZ8MTXP02JWT30.22.36.D03.1.454.CMB.2.raw
  modified_base (307)..(307): a, c, t, g, unknown or other
  misc_feature (307)..(307): n is a, c, g, or t
  modified_base (327)..(327): a, c, t, g, unknown or other
  misc_feature (327)..(327): n is a, c, g, or t
  modified_base (395)..(395): a, c, t, g, unknown or other
  misc_feature (395)..(395): n is a, c, g, or t
  modified_base (435)..(435): a, c, t, g, unknown or other
  misc_feature (435)..(435): n is a, c, g, or t
  modified_base (506)..(506): a, c, t, g, unknown or other
  misc_feature (506)..(506): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcttggtacgaggccggggggtccctgacactctcctgtgcagcctctggattcacaatcagcagcaatgccatgagtggccncaggctccgagggagggttncgagtgggtctcggggattgggaagtgagtggtcgcacgacactacgcagactccgtggacggggccncgttcaatcatctccaagacgacgacttaaccgaaaaacncgaagtagaaatctacgacaaaatgaacacgccagagccgccggacgaccgacgggaccctctaacttcgngtacgacgaaaacgtcctactttacgtttcgggcccgtcggaccgtaaccgg

SEQ ID NO: 357048 - DNA, 708 bp, Homo sapiens
  misc_feature: GZ8MTXP02IKJUT.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcactagtcagcagcaatcgccagtggtacggtttcgggtcccgccgacggtccgtaccggaggggtaaggggttgcgtagggttggggtcgtcggggtattagggaaaggttgacgttgggtcgaccacgaacgtaccgtacgcgaacgtaccgtcccggtagggaccgggggccctactttccgacttacacttccgtacgagaacgacgtaaccgttaaccgaaaacaacgtaagtacgaaactaccgtagaactaaattacggtaacacgtccctacgacggaccgaccggaacggaccgaccggtacccgttaccgtacgtttccgtacgttaccggaaaccggtaaaccgtaacccgtttacgtttaacggtttttccggggacccggtaccgggacccggtaacggttaccggtaccggggtaccgacccgggg

SEQ ID NO: 357049 - DNA, 596 bp, Homo sapiens
  misc_feature: GZ8MTXP02GK6P4.22.36.D03.1.454.CMB.2.raw
  modified_base (279)..(279): a, c, t, g, unknown or other
  misc_feature (279)..(279): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtccctgacactctcctgtgcagcctctggattcacngtcagcagcaatgccatgagttcgggtccgccgaggctccgaggggtaaggggttgcgaggtgggtcgtcggggagtttgggaagtggagtgggtcgccacacactacgcgacgaccgttccggtggacggggccgtcgttcatcatctaccagacgacgacttaccgaaaacacgagtagaatctagacaaatacgtacacgcctacgacgccgaccggacggaccgaccggtcccgtacgtaccgttacgtcgtacgaccgtaaacgtacccgttacgttacgttttccgggaccgtccggtacccgtaacccgg

SEQ ID NO: 357050 - DNA, 633 bp, Homo sapiens
  misc_feature: GZ8MTXP02IYOQA.22.36.D03.1.454.CMB.2.raw
  modified_base (377)..(377): a, c, t, g, unknown or other
  misc_feature (377)..(377): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtggggagcgttggtacaggccggggggtccagtgacactctcctgtgcagcctcgtggattcacagtcagcagcaatcgccatgagttcggtccgcgaggcctaccgaggggtaaggggttgcgtaggtcgggtcgtcggggtattgggaagtcgagtggtcgccanaccactcgcaacgaccgtcccggtgggacgggggccctcttcacgtcactcctccagacgacgacttaacccgaaaactacgagtagaatcgtagacaaatagtaacacgcctacacgccgaccggaacggaccgaccgggtacccgttaccgttaccttccgttacggtacggtaccgtaaaacgtacccttacgtttaacgtttttccgggacccggtaccggacccgtaccgttaccggtccggggtacccgg

SEQ ID NO: 357051 - DNA, 523 bp, Homo sapiens
  misc_feature: GZ8MTXP02IOVYO.22.36.D03.1.454.CMB.2.raw
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (318)..(318): a, c, t, g, unknown or other
  misc_feature (318)..(318): n is a, c, g, or t
  modified_base (354)..(354): a, c, t, g, unknown or other
  misc_feature (354)..(354): n is a, c, g, or t
  modified_base (365)..(365): a, c, t, g, unknown or other
  misc_feature (365)..(365): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtctttgactctgtctcctgtaccaacaacacccagaccaaacccccatcatcattangtntcactcgtcgccctnaggatctctcatcgcttctcagctcagtctgcaacncgcctcctacntctcgtggctcagttgagacgagtctacttatactgtctagtttaccttaaatggctctacttccgtgttcggtttcggcggtacgtccgaacgtacgtcgacccgtccgtcggtccacgcccgaacggcctcgcccccgtcggtacctaccgttccg

SEQ ID NO: 357052 - DNA, 626 bp, Homo sapiens
  misc_feature: GZ8MTXP02GDO4S.22.36.D03.1.454.CMB.2.raw
  modified_base (250)..(250): a, c, t, g, unknown or other
  misc_feature (250)..(250): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccaggggaaggggttgcagtgggtctcggggattggaagtgatggtgccacacactacgcagactccgtgagggccgcttcatcatctccagagacgattaccgaaaacncagtgaatctgcaaatgtacagcctcagcgccgaggacacggccgtctacttctgtgacgaaagacctcttatttttgggccgcggccgacctacgtggggccaggggcacccgtggtccaccgtctcttcacgcctccaccaacgggcccacgtccggtccttcccccgtggcccgccctcgctcccgaggacgccacctccgacgacgccgaacgacgccggcccgtcggggccgtcggcccgtacgggtaccgaaacgggtaccttaccgtttccccgaacggtaccggttaaacgttcggttacccgttgggtaaccgggccggggccgttacggggaccgaaaacggggccccggacgtaacgttaacggg

SEQ ID NO: 357053 - DNA, 648 bp, Homo sapiens
  misc_feature: GZ8MTXP02J1IC9.22.36.D03.1.454.CMB.2.raw
  modified_base (308)..(308): a, c, t, g, unknown or other
  misc_feature (308)..(308): n is a, c, g, or t
  modified_base (330)..(330): a, c, t, g, unknown or other
  misc_feature (330)..(330): n is a, c, g, or t
  modified_base (370)..(370): a, c, t, g, unknown or other
  misc_feature (370)..(370): n is a, c, g, or t
  modified_base (395)..(395): a, c, t, g, unknown or other
  misc_feature (395)..(395): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggcttgggtacgagggcccgggggggtccctggacactctcctgtgcagcctctggattcacagtcagcagcaatgccatgagttggccncgaggctcgagggacggggttncgaggtggtcgtggggattgggaagtgagtggtgccaacncaactacgcacggtaccgttccggnggacgggggccctcttcgactccgatccctaccgaagacgacgtacttaacccggaaaactacgagttagaaactcgtagaaccaaagtcgtaacaacgcctacgacggacccggaccgaacgggacccgaaacccgggcccgtttaccgttaaccgttccgtacggtacggaccgtaaaacgtcccttacgtttaacgtttcggggacccgtcgggaccccgtacgttaccggtcgggggaccctaccgggg

SEQ ID NO: 357054 - DNA, 622 bp, Homo sapiens
  misc_feature: GZ8MTXP02G7U1U.22.36.D03.1.454.CMB.2.raw
  modified_base (218)..(218): a, c, t, g, unknown or other
  misc_feature (218)..(218): n is a, c, g, or t
  modified_base (251)..(251): a, c, t, g, unknown or other
  misc_feature (251)..(251): n is a, c, g, or t
  modified_base (621)..(621): a, c, t, g, unknown or other
  misc_feature (621)..(621): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgagggaaggggttgcagtgggtctcggggattggaagtgatggtgccacacactacgcagactccggtgagggccncttcatcatctccagagacgattaccgaaaacncagtagaatctgacaaatgtacacgcctcagcgccgaggacgaccggcctctacttcgtgtgacgaaacgtaccttcgttacgttttcgggccgcggtccgaccgtacgtcggggccacggggccacccgtcggtcctaccggtctccgttccacgtccctaccgaacccgaacgggcccctaacgttcccggttccccttcccccgtcgggcccgtccccgtcgcccgtcccgaacggccgacccgacccgtaccggacgacgaccacgacgcccggccgtcgggctcggccgtgggtacaacggtacctaccgttaccgacgtcgtacgtcgtcgtaggcggcgggtacgcggacgaggccgacgagng

SEQ ID NO: 357055 - DNA, 659 bp, Homo sapiens
  misc_feature: GZ8MTXP02GKKTO.22.36.D03.1.454.CMB.2.raw
  modified_base (362)..(362): a, c, t, g, unknown or other
  misc_feature (362)..(362): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctgaccactctcctgtgcagcctctggattcacagtcagcagcaatgccatgagttgggtccgccaggctccgaggggaggggttgcaggtgggtcgtcggggattggaagtgagtgggnccacgacactacgcagacctccggtggacgggggcccgtcttaccgactcgactcctacccgaaggtaacgaccgtaacgtttaaccccgaaaaacaccgtaagttacgaaacttccgtagaacgtaaaatcgtaacgacgaccctacgacggccgaccggacggaccgaaccgggcccgttacgttacccgttcgtcggtacggaaccgtaaaacgtacccgttactttacggttttcggggccccggtaccgggtcccggtaaccgtaccggtccgggggtacccgaaccggggg

SEQ ID NO: 357056 - DNA, 576 bp, Homo sapiens
  misc_feature: GZ8MTXP02G7SBZ.22.36.D03.1.454.CMB.2.raw
  modified_base (306)..(306): a, c, t, g, unknown or other
  misc_feature (306)..(306): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactagttggtcttttgactctgtctcctggtaccaacaacacccagaccaaaccccccatcatctattangtgtcactcgtcggccctcgaggagtctcctcatcgtcttctcaggcctaccaagtcctgccaaacgaccggtccctaccctaaacctactccgtcgtcgggcccttaccgtaggtttgacggtacgtacgttcttaacttattactggtactacgtttactttaaagtcggcctctactcgtcgttcggtttcggcggtacgcgacgtaacgtcgaccgtccgtcggtacacgaaccgtaaggcctcgcccccgtggtcctacgttccg

SEQ ID NO: 357057 - DNA, 647 bp, Homo sapiens
  misc_feature: GZ8MTXP02HCV6U.22.36.D03.1.454.CMB.2.raw
  modified_base (315)..(315): a, c, t, g, unknown or other
  misc_feature (315)..(315): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggcttattttaaaaggtgtcaagtgtgcggtgaaggtattggagtcgtgggggagcttgggtacagggcccggggggtccctggacactctcctgttcagccctctggattcacagtcagcagcaatgccatgagtttgggcccncaggctccggaaggggtaaggggttgacgaggtgggtcgtcgggggatttggggaagtgagtggggtgcccaacgacaccgtacgcgaacgaccgtcccggtgggaacggggcccgtcttcgactcgtactcctaccgaagacgaaccgtaacttaacccggaaaaacaaccgaaggtacgaaacgttcgtacggactaaaagtacgtaaccacggaccctacgaccgccggaccgaacggaccgaccgggtcccgtactaccgttcgtcgtacgacgaaacgtaaccgttcgttaacgttttcggccggtccggacccgtacgtacccggg

SEQ ID NO: 357058 - DNA, 581 bp, Homo sapiens
  misc_feature: GZ8MTXP02IYNPO.22.36.D03.1.454.CMB.2.raw
  modified_base (193)..(193): a, c, t, g, unknown or other
  misc_feature (193)..(193): n is a, c, g, or t
  modified_base (340)..(340): a, c, t, g, unknown or other
  misc_feature (340)..(340): n is a, c, g, or t
  modified_base (398)..(398): a, c, t, g, unknown or other
  misc_feature (398)..(398): n is a, c, g, or t
  modified_base (409)..(409): a, c, t, g, unknown or other
  misc_feature (409)..(409): n is a, c, g, or t
tcagacatacgcgtcacgaccggtgctcgatttagctgcgtcacgatctctcttgggggagagaggagcccagcccctgggattttcaggtgttttcatttggtgatcaggactgaacagagagaactcaccatggagtttgggctgaagtggcttttgcttgtggcttaattttaaaaggtgtcaagtgtgnggtgaaggtattggagtcgtgggggaggtcttggtacgagggcccgggggggtccctggaccactcctccgtgtgcagcctctggattcacagtcagcagcaatgccatgagttcgggtccgccgaggctccgaaggggaggggttncgaggtggtcgtcggggattggaagtgagtggtcgcacacactacgcagacctccggngacggggcctntcatcatcctcagagacataaccgaaaatacagtgaaatctagactaaatgacacgcctacgacgccgacggacgacaccggccgttcctacttcgacgtacgacgaaacgtaccttacgttacgtttccggggcctccggaccgtactaccgggtcgggacccgaaccggg

SEQ ID NO: 357059 - DNA, 610 bp, Homo sapiens
  misc_feature: GZ8MTXP02GAQGS.22.36.D03.1.454.CMB.2.raw
  modified_base (350)..(350): a, c, t, g, unknown or other
  misc_feature (350)..(350): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacacccaggaccaaaccccccaactcatcatttatggtgtcactcgtcggcccctcaggacgtctcctcatcgcttcncaggctccaagtctggcaacacggccctaccctaaactctctctgggccttccagtttcgacggacgtacgtcttacttattaccgtcgtactacgtttaccctttaaagttacggcctacctacgttcctcggtttcgggttttaccggcggtacgggcctacccggaaacggttccggaacccggttcccgtaccgggttccaccggtccccgaaacgggtcccttaccggccccccgtcggtaccctacctttcccg

SEQ ID NO: 357060 - DNA, 590 bp, Homo sapiens
  misc_feature: GZ8MTXP02FQW7Y.22.36.D03.1.454.CMB.2.raw
  modified_base (291)..(291): a, c, t, g, unknown or other
  misc_feature (291)..(291): n is a, c, g, or t
  modified_base (300)..(300): a, c, t, g, unknown or other
  misc_feature (300)..(300): n is a, c, g, or t
  modified_base (303)..(303): a, c, t, g, unknown or other
  misc_feature (303)..(303): n is a, c, g, or t
  modified_base (318)..(318): a, c, t, g, unknown or other
  misc_feature (318)..(318): n is a, c, g, or t
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacagtgactattgggtcttttgactctgtctctgtaccacacacccagcaaaccccccancatcattangtntcactcgtcgccctnaggatctcctcatcgcttcncaggcctccaagtctgacaacnccggaccctcccaaaccactcctcgtcggccttccacggtttgaacggtacgtacgtcttactttaattactgtacttaacgtttacctttaaaagttacggccgtacctacgttcgttccggttcggggttttccgggcggtacggtacgaccgtaacggtaccggtaccgtccgtccggtccgtacgcccgtacgacgtcccgtccccgtccggtccgtaccttcccg

SEQ ID NO: 357061 - DNA, 603 bp, Homo sapiens
  misc_feature: GZ8MTXP02HKR38.22.36.D03.1.454.CMB.2.raw
  modified_base (303)..(303): a, c, t, g, unknown or other
  misc_feature (303)..(303): n is a, c, g, or t
  modified_base (418)..(418): a, c, t, g, unknown or other
  misc_feature (418)..(418): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaagttttaaaaggtgtcaagtgtgcggtgaaggtattggagtcgtgggggagcttggtacgaggccggggggtccctgacactctcctgtgcagcctctggattcacagtcagcagcaatgccatgagttcggccnccgaggctccgagggagggttgcaggtgggtctcggggattggaagtgacgtggtacgccaacacacgtacgcacgaccgtccggtggacgggggccctcgttcatcaacttccnccaagagaccgtattaacccgaaaactacgacgttagaaactctagactaaaatcgtacacgccctagacggcccgacgacggaccgacggtcccgtactacgttccgtgtacgacgtaaacgtcccgtacgttttaacgtttcgggacccgcgggtacccgaacgtcggtcggggaccaccggg

SEQ ID NO: 357062 - DNA, 553 bp, Homo sapiens
  misc_feature: GZ8MTXP02I3PKN.22.36.D03.1.454.CMB.2.raw
  modified_base (304)..(304): a, c, t, g, unknown or other
  misc_feature (304)..(304): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaaggtgtcaagtgtgcggtgaaggtattggagtctgggggaggcttggtacaggccgggggggtccctggacactctcctgtgcagcctctggattcacagtcagcagcaatgccatgagttgggtccnccaggctccgaggggaaggggttgcgaggtggggtctcggggattgggaaagtgatggtgccacgacactacgcagactccgtgacgggggccgttcatcatctccagagacgacttaccgaaaacacagtgaaatactagacaaatagtacacgccctcgacgcgacgacggacgaccggccgtctacgttctgtcgacgaaacgacctctagttttcggccgtcggccgacgtacgtcgggcgacgg

SEQ ID NO: 357063 - DNA, 723 bp, Homo sapiens
  misc_feature: GZ8MTXP02IHP3F.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttcctgcacgtgggaaccaacgagtgactagttgggttcttttgactctgtctccgtaggtaacccaaacaaccgaccccaacggtaccccaaaacccccccaactcctaactacctattttagtcggttctaccacgttccggtccggccctacgacggtacgtccttccctctacgtcccgtctttcgtccgtacgggtcccttaaccgtaaggttcctacgggaccctaaccgaccgtacccctaccctaaaccacttccgtcgtcgggtccttccgtaggtttcgaacggtacgtacgttcttaaactttattactgttacgttacgttttaacccgtttaaagtcggacctacctacgttccgttacggttcgggtttcggacgggtacgacgtaacccggaaagttccgggtacccgttccgtccggttaccgaaccggtaacccggtaaaccggtcccgttaccccgtacccccggtttacggtacccttacggtttcccccg

SEQ ID NO: 357064 - DNA, 690 bp, Homo sapiens
  misc_feature: GZ8MTXP02HSKMU.22.36.D03.1.454.CMB.2.raw
  modified_base (306)..(306): a, c, t, g, unknown or other
  misc_feature (306)..(306): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcttgggtacgaggccggggggtccctgaccactctcctgtgcagcctctggattcacagtcagcagcaatgccatgagttgggcctnaggctcgaggggtagggtgcgtgggtggtcggtgggtagtagggagtgtacgtggtaccgccacactaccgtacgcgacgtaccgtcgtaggggaccggggtcctcttacgactcacgttccacgaaggtaccgaaacgtaccgttaaaccgaaaactcgaggtacaaacttccgtaaggaaacttaaaagtcgtaaacccgaccgtaccgacggaccggacccggtaccggaaccggtacccggacccggttcccttacgtttacccgttcggtaacggtaaccggtaaaccgtaaccgttcccgtttacggtttacggggttcccgggcccggtaccggtacccggtaacggttacccggggtaccggggacccgtacccgg

SEQ ID NO: 357065 - DNA, 608 bp, Homo sapiens
  misc_feature: GZ8MTXP02GK0SQ.22.36.D03.1.454.CMB.2.raw
  modified_base (172)..(172): a, c, t, g, unknown or other
  misc_feature (172)..(172): n is a, c, g, or t
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (325)..(325): a, c, t, g, unknown or other
  misc_feature (325)..(325): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
  modified_base (360)..(360): a, c, t, g, unknown or other
  misc_feature (360)..(360): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctgccctgacccngcctgcctccgtgtctggatcatctggacagtcgatcagctatttccngcacgtgggaccaacgngtgactagttgggttcttttgactctgtctccgtggtaacccaacaaccacccgacggacccaaaccccccatcatctatttatggtntcactcgtcgcctnaggntctcctcactcgcttcncgagtcctcagtcgtgaccaacgccgccctaccctacactctcgtcggctcctaggttcgaacggacgtagtccttaacgttattactcgtactaacgttttaccttaaagtcgacgtcctaccgttcgttcggttcgggtttacggcgggtacgtccgaccggtacgtccggtacccgttccgtccggttaccgaccggtaaccgtaccggtccgtccggtccccccgtcggtccctacctttcccg

SEQ ID NO: 357066 - DNA, 563 bp, Homo sapiens
  misc_feature: GZ8MTXP02HAOHY.22.36.D03.1.454.CMB.2.raw
  modified_base (218)..(218): a, c, t, g, unknown or other
  misc_feature (218)..(218): n is a, c, g, or t
  modified_base (250)..(250): a, c, t, g, unknown or other
  misc_feature (250)..(250): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccaggggaaggggttgcagtgggtctcggggattggaagtgatggtgccacacactacgcagactccgtgaggggccnttcatcatctccagagacgattaccgaaaacncagtgaatctgcaaatgtacagcctcagcgccgaggacacggccgtctacttctgtgcgaaagtcctcttagttttgggccgcggccgacctacgtgggccagggcacccgtggtccaccgtctcttcagccctccaccaacgggcccagtccgtccttcccccgtgccgcccctggccctccgacggcgccaccctccgagacgccgaacgcggcccggcccgtcggggctcggcccgtggtaccaaacgggtacctacgttcccgaacgtcgtactcgtcgtggacgcgggctcggcgaaggcgacgagag

SEQ ID NO: 357067 - DNA, 583 bp, Homo sapiens
  misc_feature: GZ8MTXP02FLP0A.22.36.D03.1.454.CMB.2.raw
  modified_base (403)..(403): a, c, t, g, unknown or other
  misc_feature (403)..(403): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccggggggtccctgacactctcctgtgcagcctctggattcacagtcagcagcaatgccatgagttgggccgccaggctccgaggggaaggggttgcgaggtgggtcgtcggggattgggaaagtggacgtggtcgccaacacactacgcagaccgtccggtgggacgggggccncttcatcatctaccgagaagacgaacttaccgaaaacacaagtacgaaatccgtagacaaatcgtaacagaccctacgacgccgacggagaccgaccggccgtactacttctagtacgacgaaacgtacctcgttacgttttcgggccgtcggaccgtacgtacggtcgggaccgacggg

SEQ ID NO: 357068 - DNA, 638 bp, Homo sapiens
  misc_feature: GZ8MTXP02GH7W3.22.36.D03.1.454.CMB.2.raw
  modified_base (406)..(406): a, c, t, g, unknown or other
  misc_feature (406)..(406): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacagggccggggggtccctgacactctcctgtgcagcctcgtggattcacagtcagcagcaatgccatgagttcggtccgccgaggctccggaggggaaggggttgcgaggtgggtcgtcggggagttggaagtgagtggtcgccacacacctacgcagacgtccggtggacgggggtccncgtttcatcgactcctcagacgacgtacttaccgaaaactcgagtgaaatctagacaaagttcgtaacgacgacctacgacgaccgaccggagacccgaccgggtaccgtaccgttactttacgtacggtacggaaccggtaaacgtacccgttcgtttaacggtttttcggggaccccggtaccgggtacccggtaccgttaccgggtccgggggtaccccgtacccgggg

SEQ ID NO: 357069 - DNA, 647 bp, Homo sapiens
  misc_feature: GZ8MTXP02I1T6S.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccgggggggtccctggacactctcctgtgcagcctctggattcacagtcagcagcaatgccatgagttgggtccgccaggctccgaggggtaggggttgcgaggtgggtcgtcggggtattgggaaggtgagtggcgccaacgacactacgcaacgaccgtcccggtaggacgggggccctcgttacactccactcctcccgaagacgaacgtacgttaacccgaaaacacgaagtagaaactcgtacgaactaaagtcgtaacgacgcctacgaacggccgaccggacggaccgtaccggcccgttactacgttcgtcggtacgaacgaaacggtacccttacgtttaacggtttttcggggcccggtaccgggtacccggtaccgttaccgggtcgggggtacccgtaaccggggg

SEQ ID NO: 357070 - DNA, 572 bp, Homo sapiens
  misc_feature: GZ8MTXP02HZYA2.22.36.D03.1.454.CMB.2.raw
  modified_base (400)..(400): a, c, t, g, unknown or other
  misc_feature (400)..(400): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacgaggccgggggggtccctggaccactctcctgtgcagcctctggattcacagtcagcagcaatgccatgagttggtccgcaggcctccgaggggaaggggttgcgaggtgggtcgtcggggattgggaagtgagtggtcgccacgacactacgcagactccgtgacggggccnttcatcatctcagagacgtacttaccgaaaacacagtagatctagactaaatagtacacgcccgcgacgcgacgacggaccgaccgccgtctacgttcgtcgtacgacgaacgtaccgttacgttacgtttccggccggtccggtaccgtacgtaccggtcgggaccgacgg

SEQ ID NO: 357071 - DNA, 531 bp, Homo sapiens
  misc_feature: GZ8MTXP02I97OS.22.36.D03.1.454.CMB.2.raw
  modified_base (307)..(307): a, c, t, g, unknown or other
  misc_feature (307)..(307): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaactcatcatttanggtgtcactcgtcggccctcaggagtctcctcatcgcttctcaggctccaagtctggcaacacggcctccctaacactctctgggctccagtttgaggacgagtcttaacttattacctgtctagtttcctttaaaattagcgactactctcgttgtttcggcggaggtcacggacgtgaccgtctacggtcaacgccaacggctcgcccctcggtcacttccg

SEQ ID NO: 357072 - DNA, 567 bp, Homo sapiens
  misc_feature: GZ8MTXP02IS6X7.22.36.D03.1.454.CMB.2.raw
  modified_base (308)..(308): a, c, t, g, unknown or other
  misc_feature (308)..(308): n is a, c, g, or t
  modified_base (558)..(558): a, c, t, g, unknown or other
  misc_feature (558)..(558): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctggtaccaacaacaccacgaccaaaccccccatcatcatttatggtntcactcgtcggccctgagacgtctcctcatcgcttctcacggctccaagtctgcaacacgccctacccaacactctacgtcggctcgagtttgaggacgagtcttacttattactcgtctacgtttctttaaatcggcgtcctactcgttcgttcgggtttcggacggtacggtccgaccggtaaggtccgtaccgtccgttaccgggtacaccggtaacccgaacggtcctcgtcccccgtcggtaccncctttcccg

SEQ ID NO: 357073 - DNA, 541 bp, Homo sapiens
  misc_feature: GZ8MTXP02F3OQA.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggccaaaccccccaactcatcatttatggtgtcactcgtcggccctcaggagtctcctcatcgcttctcaggctcaagtctgcaacacggccctccctaaccatctctggctccagtttgaggacgagtctacttattactgtactagtttacctttaaagttacgcgtcctactcttacgttggttttcggcggtacggcaccggaagtcggaccgtccgtcggtccacgccgaacggcctcgcccctcgtccgactccg

SEQ ID NO: 357074 - DNA, 614 bp, Homo sapiens
  misc_feature: GZ8MTXP02JS466.22.36.D03.1.454.CMB.2.raw
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgaggggaaggggttgcaggtgggtctcggggattggaagtgatggtgccacacactacgcagactccgtggaggggccncttcatcatctccagagacgattaccgaaaacncagtgaatctgacaaatgtacagcctcagcgccgaggacacggccgtctacttctgtgcgaaagaccttcgtattttgggccgcggccgacctacgtggggccagggcacccgtggtccaccgtctcttcacgccctccacccgaacgggcccagtccggtccttcccccgnggccnccctgcctccgaggacgccacccgtccgacgcgcacgacggcccggcccgtgggcctcggcccgttgggtaccgtaaacgggtaccttaacccgttcccgaaccggtccggttaacgtccgttaccgtgggcgggcccgggggtcgtacgggggaccgaaaggggccccgacgtaaacggtcg

SEQ ID NO: 357075 - DNA, 532 bp, Homo sapiens
  misc_feature: GZ8MTXP02HQJ4T.22.36.D03.1.454.CMB.2.raw
  modified_base (306)..(306): a, c, t, g, unknown or other
  misc_feature (306)..(306): n is a, c, g, or t
  modified_base (330)..(330): a, c, t, g, unknown or other
  misc_feature (330)..(330): n is a, c, g, or t
  modified_base (447)..(447): a, c, t, g, unknown or other
  misc_feature (447)..(447): n is a, c, g, or t
  modified_base (458)..(458): a, c, t, g, unknown or other
  misc_feature (458)..(458): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttggccnccaggctccgaggggaaggggttncaggtgggtctcggggattgggaagtgagtgggtcgcacacactacgcagactccgtgacgggccgcttcatcatctccagacgacgattaccgaaaacacagtagaatctgacaangtacagcctanagcgccgaggacacggccgtctacttcgcgtcgacgtaaacgcctacttacgtttggcccgtcggaccgtaccg

SEQ ID NO: 357076 - DNA, 603 bp, Homo sapiens
  misc_feature: GZ8MTXP02HCKPE.22.36.D03.1.454.CMB.2.raw
  modified_base (317)..(317): a, c, t, g, unknown or other
  misc_feature (317)..(317): n is a, c, g, or t
  modified_base (358)..(358): a, c, t, g, unknown or other
  misc_feature (358)..(358): n is a, c, g, or t
  modified_base (502)..(502): a, c, t, g, unknown or other
  misc_feature (502)..(502): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaacccaacagtgactagttgggtctttgactctgtctcctggtaccaacaacacccacgacccaaacccccccatcatctattatggtntcactcgtcgccctcgaggtacgtctcctcactcgtcttcncacggctaccagtctgaccacgaccgtccctacccctaacactctcgtacggtcctcgtaggttcgaaggtaccgagttccttaatttacgttactcggtaccttaagttttacctttaaaagtaccggccgtacctaccgttnttccgggttgggtttcggcggttaggccgtaacggacgtcgacccgttccgtcggtcaccgtccgaacggtcctccggtccccgtcggtctaccgttcccg

SEQ ID NO: 357077 - DNA, 644 bp, Homo sapiens
  misc_feature: GZ8MTXP02HPUWY.22.36.D03.1.454.CMB.2.raw
  modified_base (303)..(303): a, c, t, g, unknown or other
  misc_feature (303)..(303): n is a, c, g, or t
  modified_base (405)..(405): a, c, t, g, unknown or other
  misc_feature (405)..(405): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcttgggtacgaggccggggggtccctgacactctcctgtgcagcctctggattcacagtcagcagcaatgcatgagtttggccncaggctcgaggggacgggttgcgaggtgggtcgtcggggattgggaagtgacgtgggtgcccacgacaccgtagccgaagacctccggtggagggggccccntttccgattcaactctaccaggaacgacgtacttaaccgaaaacacagtacgaatccgtgaactaaagtagtaacacgtacccacgacggacccgccggaaggaccgaccggggaccccttcggtaaccctttccgtggtaccggtaacgtaaaaccgtaccgttacgttaacggtttttccggggaccggtcccgggacccggtaccgttaccggtccgggggtaccgtaacccgggg

SEQ ID NO: 357078 - DNA, 538 bp, Homo sapiens
  misc_feature: GZ8MTXP02I9FAO.22.36.D03.1.454.CMB.2.raw
  modified_base (294)..(294): a, c, t, g, unknown or other
  misc_feature (294)..(294): n is a, c, g, or t
  modified_base (325)..(325): a, c, t, g, unknown or other
  misc_feature (325)..(325): n is a, c, g, or t
  modified_base (384)..(384): a, c, t, g, unknown or other
  misc_feature (384)..(384): n is a, c, g, or t
  modified_base (431)..(431): a, c, t, g, unknown or other
  misc_feature (431)..(431): n is a, c, g, or t
  modified_base (453)..(453): a, c, t, g, unknown or other
  misc_feature (453)..(453): n is a, c, g, or t
  modified_base (494)..(494): a, c, t, g, unknown or other
  misc_feature (494)..(494): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggagcttggtacaggccggggggtccctgacactctcctgtgcagcctctggattcacagtcagcagcaatgccangattggtccgccaggctcgagggaggggttncaggtgggtctcggggattgggaagtgacgtggtcgccacacactacgcagactccggngaggggccgcttcatcatctccagagacgattccgaaaacacagtanaatcagacaatcgacacgaccncgacgcgaccgacgaccgacgccgttactacttcgtcgtanacgaaacgtcctacgtttacgtttcggcccgacggaccgtaacg

SEQ ID NO: 357079 - DNA, 621 bp, Homo sapiens
  misc_feature: GZ8MTXP02GO7Q9.22.36.D03.1.454.CMB.2.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctattcctgcactgggaccaacagtgacagttgggtctttgactctgtctcctggtaccaacaacacccacgccaaaccccccatcatcattatgtgtcactcgtcgccctcacggtagtctctccatccgtcttctcacggctccgaagtctcggaccaaccgaccgcctacccaacctatccgtctcgggtcctccgtagtttacggacggtacgtagttaccttactttaattacgtacggtacttaacgtttaccctttaaaagttacgggtccctacctaccttcgttcggttgggttttaccgggcgggtaacggtccgaccggtaaaggtcgtaacccgtccgtcggtaccgtacgcccgaagggtcctcccggtccccctcggtaccctacttccgtttccccg

SEQ ID NO: 357080 - DNA, 629 bp, Homo sapiens
  misc_feature: GZ8MTXP02H8JAJ.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggacccaacagtgactagtttgggtctttgactctgtctcctgtaccaacaacacccacgacccaaacccccatcatcattatgtgtcactcgtcggccctgaggacgtctcctctactcgcttctcgagtcctaccgtaagtccgtacgaccaaccgaccgtccctacccctaacacttcgtcgtcgggccttaccgtaggtttaggaacggtaccgtagttaccttacgtttaactttctagtaccttagtttacctttaaaagttcggcctacctacgttcgtttcggttgggtttccgggacgggtacggtccgtaaaccggtacgtccggtacccgttccgtaccggtacacggtaacccgaggtccctccggtcccccgtacggtcctacccttcccg

SEQ ID NO: 357081 - DNA, 602 bp, Homo sapiens
  misc_feature: GZ8MTXP02HVAB7.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcagcctcgtggattcacagtcagcagcaatgccatgagttgggccgccgaggctccgaggggtaaggggttgcgaggtgggtcgtcggggatttgggaagtgatggtcgccacacactacgcagactccgtggacggggccgcttcgatcatctccgagagacgacttaaccgaaacacagtgaaatctagactaaagtgtaacacgtccacgacgccgaccggaacggaccgaccggtcccgttaccttacgtttcgtcgtacggacggaaaccgtacccttacgtttacgttttcggggcccgtccggtacccgtacgtaccggtcggggacccgaaccgggg

SEQ ID NO: 357082 - DNA, 577 bp, Homo sapiens
  misc_feature: GZ8MTXP02HJR5B.22.36.D03.1.454.CMB.2.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaanagtgacattgggtctttgactctgtctcctggtaccaacaacacccaggccaaaccccccactcatcatttatgtgtcactcgtcggccctcaggagtctcctcatcgcttctcaggctccaagtctgcaacacggccctccctaaccatctcgtggtcctcctagtttgaggacgagtcttaacttattactgactacgtttcctttaaaagttcggccgacctaacttcttccggttcgggtttttcggcgggtacggtccaccggtaaacggtcgtacccgtcccgtcggtccgaccgccccgtaagggcctccggcccccgtccggtcctaaccgttcccg

SEQ ID NO: 357083 - DNA, 574 bp, Homo sapiens
  misc_feature: GZ8MTXP02GRR2H.22.36.D03.1.454.CMB.2.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaangtgactagttggtctttgactctgtctctgtaccaacacaccagacccaaccccatcatctattangtgtcactcgcgcctgaggctctcctcatcgtcttcncgagtcctactaagtctacgaccaacgccgccctacctacactctcgtcggctacgtagttgacggtactacgttcttacttattacgtgtactacgtttacttaaagtcggctacctacgttcgttggttcgggtttcggacggtacgaccgtacggtaacggttccgacccggttccgtcggtaccgaccgaaccgtacggtccgtcccgccccgtcggtacctaccgtttcccg

SEQ ID NO: 357084 - DNA, 578 bp, Homo sapiens
  misc_feature: GZ8MTXP02G8PCO.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctgtaccaacaacaccagaccaaacccccatcatcatttatgtgtcactcgtcgccctgagacgtctcctcactcgcttctcaggcctcaagtctgacaacacgccctaccctaacactctcgtggctccgtagtttcgacggacgtagtcttaacgtttattactgtactagtttacccgtttaaaattcggccgtacctacttcgttcggtttcgggtttccgggacggtacggtaccaacggtacgttcgacccgtccgtacggtctacggaacccgaacggtcctccggcccccgtcggtcctaccgtttcccg

SEQ ID NO: 357085 - DNA, 618 bp, Homo sapiens
  misc_feature: GZ8MTXP02G0E0S.22.36.D03.1.454.CMB.2.raw
  modified_base (218)..(218): a, c, t, g, unknown or other
  misc_feature (218)..(218): n is a, c, g, or t
  modified_base (308)..(308): a, c, t, g, unknown or other
  misc_feature (308)..(308): n is a, c, g, or t
  modified_base (324)..(324): a, c, t, g, unknown or other
  misc_feature (324)..(324): n is a, c, g, or t
tcagacatacgcgtcacgaccggtgctcgatttagctgcgtcacgatctctcgttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtctttgactctgtctcctggtaccaacaacaccacgaccaaaccccccaatcatcattatggtntcactcgtcggccctnagatctctcctatcgcttctcaggtctccaagtctggcctaaccacggccctaccctaaaccatcctcgtcggctccgtagtttcggaggacgtagtaccttaactttacttacgtgtaccttaacgttaccctttaaaagttacggcctaccctacttccgttcgggtttgggttttcccgggacgggtaacggtccgaacccggtaagtcggaccccggttccgtccggtaccacccggtacccaagggccctaccggtccccccgtcggtacctaccgttccgtttccccg

SEQ ID NO: 357086 - DNA, 642 bp, Homo sapiens
  misc_feature: GZ8MTXP02INJXX.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaggtgtcaagtgtgcggtgaaggtattggagtcgtgggggagcttggtacaggccggggggtccctgacactctcctgtgcagcctctggattcacagtcagcagttcaatcgccagtggaggtttcgggtcccgccgaggccttcccggaagggggtaaggggtttgcgtaggtcggggtcgtcggggattggaagtgagtggtcgcccacgaccacgtacgccacggtaccgtccggtagggacggggtccgcttcatcatctaccgagacgaacgacttaaccgaaaacacgaagtacgtaactcgtagaacctaaagtcgtaacacgtcctacgaacggcgacccggaacggacccgaccggtacccgttaccttaccgtttccgtaggtacgaaccggtaaaacgtacccttacggtttacggtttttccggggcccggtaccggtacccgtaccgg

SEQ ID NO: 357087 - DNA, 552 bp, Homo sapiens
  misc_feature: GZ8MTXP02FHQKX.22.36.D03.1.454.CMB.2.raw
  modified_base (358)..(358): a, c, t, g, unknown or other
  misc_feature (358)..(358): n is a, c, g, or t
  modified_base (394)..(394): a, c, t, g, unknown or other
  misc_feature (394)..(394): n is a, c, g, or t
  modified_base (427)..(427): a, c, t, g, unknown or other
  misc_feature (427)..(427): n is a, c, g, or t
  modified_base (451)..(451): a, c, t, g, unknown or other
  misc_feature (451)..(451): n is a, c, g, or t
  modified_base (491)..(491): a, c, t, g, unknown or other
  misc_feature (491)..(491): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccgggggggtccctgacactctcctgtgcagcctctggattcacagtcagcagcaatgccatgagttgggccgccaggctccgaggggaaggggttgcaggtgggtctcggggattggaagtgatgggtncacacgactacggccagactccggtgacgggggccncttcatcatctccagagacgattaccgaaaacncagtagaaatcgtagtacaaagtntaacgagcctcagcgccgaggacacggccgtactacttcngtcgacgaaacgtaccctacttagtttcgggccgtcggccgactacgtcggggacgacggg

SEQ ID NO: 357088 - DNA, 607 bp, Homo sapiens
  misc_feature: GZ8MTXP02GCQ7K.22.36.D03.1.454.CMB.2.raw
  modified_base (364)..(364): a, c, t, g, unknown or other
  misc_feature (364)..(364): n is a, c, g, or t
  modified_base (402)..(402): a, c, t, g, unknown or other
  misc_feature (402)..(402): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccgggggggtccctgacactctcctgtgcagcctctggattcacagtcagcagcaatgccatgaggttcgggccgccaggcctccgaggggaaggggttgcgaggtgggtcgtcggggatgggaagtgagtggngccacacactacgcagacctccggtggacgggggaccncgttcatcgactctccagagacgactaccgaaaacacagagaaactctagacaaatacgtacacgcctacgacgcgaccggacggaccgaccgggaccgtctaaccgttccgtacggtcggaccggtaaacgtacccgttactttaacggttttcggggcccgtacgggaccccgtacgtaccggtccgggggaccgaaccgggg

SEQ ID NO: 357089 - DNA, 640 bp, Homo sapiens
  misc_feature: GZ8MTXP02IY2H5.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtcctgacactctcctgtgcagcctctggattcacagtcagcagcaatgccatgagttcgggtcccgccaggctccgaaggggaaggggtttgcgaggtgggtctcggggtattgggaaagtgagtggtgccacacactacgcagcctccggtagacgggggcctacgttcacgtctactccgtaccaacggagaacgtaccgttaacccgaaaacgtaacctaacggtagaaacttactagtaacctaaagttacgtaacgaccgtaccctcgacggccgaccggacggaaccgaccggtcccgttacgttacttcgtcgtacggaaccgtaaacgtaccttacgtttacgttttcgggacccggtcggaccgtacgtaccggtacggggacccgtaccgggg

SEQ ID NO: 357090 - DNA, 602 bp, Homo sapiens
  misc_feature: GZ8MTXP02F8WAV.22.36.D03.1.454.CMB.2.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (236)..(236): a, c, t, g, unknown or other
  misc_feature (236)..(236): n is a, c, g, or t
  modified_base (362)..(362): a, c, t, g, unknown or other
  misc_feature (362)..(362): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacngtcgatcagctatttccngcacgtgggaccaacgngtgactagttgggtcttttgactctgtctctgtaaccaacaaccacccacgacccaaaccccccatcatctatttatggtctcactcgtccggtccctagaggacttctcctacactcgtccttcncgaggtcctaccaagtctacgaccaaccgaccgtccctaccctaacctactcctcgtcggtcctccgtagtttagacggacgtacgtacttaacttattactcgtacttacgtttactttaaagtccgtacgtacctacgttcgttcggttggtttcggcggtacgtaccgacggtacgtcgtaccgtcgtaccgtcgaccgtaaccgacgtcctcccgccccgtcggtacctcttcccg

SEQ ID NO: 357091 - DNA, 784 bp, Homo sapiens
  misc_feature: GZ8MTXP02GXI5P.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtggcggtgaaggtattggagtcgtgggggaggcttgggtacgaggccggggggtccctgacactctcctgtgcagcctctggattcacagtcagcagcaatcgaccagtggaggtttcggggtcccgccgaggcctacccggaaggggtaaggggttgcgtagggtcgggtcgtcggggattgggaagtggagtgggtcgacccaacacaccgtacgccgacggaccgttcccgggtagggaccggggggtcccctactttacctaacgtccgtaacttcccgtacccgaaaggaaacgtaaacccgtaaaccgtttaaacccccgaaaaaaacctaaccgtaaaggtaacgtaaaacttacccgttaaaggaaaccttaaaacgttacgtaaaccgtaaccggtacccccttacggaaccggacccgggaaccccgggaacgggaaccccgtaaacccgggtccccggttaaccttacccgtttcgtacggtacggaaaccgtaaaacgtaaccctttacgtttaacgggttttccggggccccggtaccggtacccggtaaccgtaccgggtccgggggacccgtacccggggg

SEQ ID NO: 357092 - DNA, 656 bp, Homo sapiens
  misc_feature: GZ8MTXP02IUXTE.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggattcacagtcagcagcaatcgccatgaggttgggtcccgccgaggcctaccggaggggaaggggttgcgaggtgggtcgtcggggatttgggaaagtgagttggcgccaacacacgtacgcacgacctccgggtggaccgggggcctacgtttcactcactacctccgaagacgaacgacttaaccgaaaacacagtagaatctagaactaatacgtacacgccctacgacgaccggaccggaacggaccgaccgggtacccgttacgttaccgttcgtacggttcggtaaaccggtaaaccggtaacctttcgtttaacggtttttccggggacccggggtccggttacccggaaccgtaaccgggtccgggggtacccggaacccgggg

SEQ ID NO: 357093 - DNA, 553 bp, Homo sapiens
  misc_feature: GZ8MTXP02I6V6S.22.36.D03.1.454.CMB.2.raw
  modified_base (329)..(329): a, c, t, g, unknown or other
  misc_feature (329)..(329): n is a, c, g, or t
  modified_base (442)..(442): a, c, t, g, unknown or other
  misc_feature (442)..(442): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtccctgacactctcctgtgcagcctctggattcacagtcagcagcaatgccatgagttggccgccaggctccgaggggtagggttncgaggtgggtcgtcggggattgggaagtgagtggtgcccagacactacgcagaccgtccggtggacggggccgcgttcactcagtctccgagacgacgtacttaccgaaaacncaagtgaatctagacaaatgtacagcctcacgcgaccggacggaccacggccgtctacttcgtcgtcgacgaaagtccttacgttacgtttcggcccgtcggaccgtaccg

SEQ ID NO: 357094 - DNA, 545 bp, Homo sapiens
  misc_feature: GZ8MTXP02FE9P7.22.36.D03.1.454.CMB.2.raw
  modified_base (251)..(251): a, c, t, g, unknown or other
  misc_feature (251)..(251): n is a, c, g, or t
  modified_base (413)..(413): a, c, t, g, unknown or other
  misc_feature (413)..(413): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccaggggaaggggttgcagtgggtctcggggattggaagtgatggtgccacacactacgcagactccgtgaggggccgcttcatcatctccagagacgattccgaaaacncagtgaatctgcaaatgtacagcctcagcgccgaggacacggccgtctacttctgtgcgaaaagcctcttatttttgggccgcggccgacctacgtggggcagggcaccctggtcaccgtctcttccagcctccaccaacgggcccatcggtccttcccccnggcccgccctgccctccacggacgccacccgtccgagacgcacgagcccggcccgtggggctcgccgtggtcaacgggactacttcccacgcgtactcgtctggacgcgggctcggacaggcgaccgagtag

SEQ ID NO: 357095 - DNA, 610 bp, Homo sapiens
  misc_feature: GZ8MTXP02IAFSN.22.36.D03.1.454.CMB.2.raw
  modified_base (298)..(298): a, c, t, g, unknown or other
  misc_feature (298)..(298): n is a, c, g, or t
  modified_base (301)..(301): a, c, t, g, unknown or other
  misc_feature (301)..(301): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagcatttcctgcactgggaccaacagtgacattgggtctttgactctgtctcctggtaccaacacaccagccaaacccccatcatcattangtntcactcgtcggccctcaggacgtctcctcatcgcttctcacggtcctaccgaaagtcctacggaccaaccgacgtcccctacccctaaaccacttcctcgtcgggccttcgtagtttcgaacggtacgtagtactaactttattaacctgtactagtttacctttaaagttcggcctacctactcgttcggttcgggttttccgggacggtacggtaccgtaccggtaaacgttcggacccgttcccgtccggttacaccgtccccgaaggtcccgtaccggccccccgttcggtacctaccgttcccg

SEQ ID NO: 357096 - DNA, 671 bp, Homo sapiens
  misc_feature: GZ8MTXP02IQPS7.22.36.D03.1.454.CMB.2.raw
  modified_base (318)..(318): a, c, t, g, unknown or other
  misc_feature (318)..(318): n is a, c, g, or t
  modified_base (333)..(333): a, c, t, g, unknown or other
  misc_feature (333)..(333): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgccactgggacccaacagtgactagttgggttcttttgactctgtctcctggtaccaaacaaccacccacgacccaaaccccccactcatcatttatgtntcactcgtcgccctnagatctctcatcgcttctcacggtcctaccgaatcgtacgaccaacgcggtccctaccctaaccactcctccgtcggggtcccttaccgtaggtttacgaacggtaacggtacgttcctttaaaccttttagttaccgttcgtaccttaccggttttacctttaaaacggttacggcccgtaccctaccgtttcgttcgggtttacgggttttcgggcgggtacggtacccgaaaccggtaaggttcccggtaccccggttccgttaccgggtccaaccggtaacccgaacggtcccgtaccccggtcccccgtaccggttaccctaccgtttccccg

SEQ ID NO: 357097 - DNA, 552 bp, Homo sapiens
  misc_feature: GZ8MTXP02IXMLY.22.36.D03.1.454.CMB.2.raw
  modified_base (306)..(306): a, c, t, g, unknown or other
  misc_feature (306)..(306): n is a, c, g, or t
  modified_base (364)..(364): a, c, t, g, unknown or other
  misc_feature (364)..(364): n is a, c, g, or t
  modified_base (369)..(369): a, c, t, g, unknown or other
  misc_feature (369)..(369): n is a, c, g, or t
  modified_base (386)..(386): a, c, t, g, unknown or other
  misc_feature (386)..(386): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaggtgtcaagtgtgcggtgaaggtattggagtcgtgggggaggcttggtacaggccggggggtccctgacactctcctgttcagcctctggattcacagtcagcagcaatgccatgagttggtccnccaggctccgaggggaaggggttgcaggtgggtcgtcggggattggaagtgatgggtnccacncactacgcagactccgngacggggccgcgttcatcatctccagagacgattaccgaaaacacaacgtagaactctgacaaatagtacacgcctcgacgcgccgaggaccacggaccgtctactctcgtacgacgaaacgtaacctcgttacgttttcgggaccgtccggccgtacgtaccggg

SEQ ID NO: 357098 - DNA, 586 bp, Homo sapiens
  misc_feature: GZ8MTXP02GUVA1.22.36.D03.1.454.CMB.2.raw
  modified_base (305)..(305): a, c, t, g, unknown or other
  misc_feature (305)..(305): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacgaggccgggggggtccctgacactctcctgtgcagcctctggattcacagtcagcagcaatgccatgagttgggtccncgaggctccgaggggaggggttgcgaggtgggtcgtcggggattgggaagtgactgggtcgccacacacctacgcgagactccggtgacgggggcctcttcatcatctccagacgacgacttaccgaaaacacagtagaaatctagacaaatgtacacgccctacgacgccgaccggacgacgaccggccgtactaccttgtcggtcgacgtaaacgaccccttgtttaacgttttcggggacccgtcggtacccgaacgtcggtcggggaccgaccgggg

SEQ ID NO: 357099 - DNA, 587 bp, Homo sapiens
  misc_feature: GZ8MTXP02HFGUE.22.36.D03.1.454.CMB.2.raw
  modified_base (217)..(217): a, c, t, g, unknown or other
  misc_feature (217)..(217): n is a, c, g, or t
  modified_base (315)..(315): a, c, t, g, unknown or other
  misc_feature (315)..(315): n is a, c, g, or t
  modified_base (408)..(408): a, c, t, g, unknown or other
  misc_feature (408)..(408): n is a, c, g, or t
  modified_base (431)..(431): a, c, t, g, unknown or other
  misc_feature (431)..(431): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattccgaaaaccagtgaatctgcaaatgtacagcctcagcgccgaggacacggccgtctacttctgtgcgaaagcctntagtttttgggccgcggccgacctacgtcggggccagggcaccctggtccacgtctcttcacgcctccacacgggcccagtcgtccttccccnggcccgccctcgcctccgagacnccacctccgagcgccacgacgccggcccgtcgggcctcgcccgttacgggtaccaaacgggtaccttaacccgtttccgaaaccggtccgttaagttcgtaccgttcggaacggccggggtccgtcgggacccgaacggggcctaccgacgtacgg

SEQ ID NO: 357100 - DNA, 571 bp, Homo sapiens
  misc_feature: GZ8MTXP02ILCZH.22.36.D03.1.454.CMB.2.raw
  modified_base (308)..(308): a, c, t, g, unknown or other
  misc_feature (308)..(308): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaggtgtcagtgtgcggtgaaggtattggagtcgtgggggaggcgttgggtacgaggccggggggtccctgacactctcctgttcacgcctctggattcacagtcagcagcaatgccatgagttggccnccaggctccgaggggaggggttgcgaggtgggtcgtcggggtattgggaagtgagtgggtcgccctacacacgtacgcagacccgtcggtgggacggggccgtctcagtcatcctacacgacgacgtaactaccgaaaacacagtagaactctagacaaatcgtacacgctacgacgcgacgagacgacggcgtctactctcgtacgacgtaacgtaaccgttcgtttacgttttcgggccgtccggtaccgaccgtaccggg

SEQ ID NO: 357101 - DNA, 647 bp, Homo sapiens
  misc_feature: GZ8MTXP02FWHF8.22.36.D03.1.454.CMB.2.raw
  modified_base (301)..(301): a, c, t, g, unknown or other
  misc_feature (301)..(301): n is a, c, g, or t
  modified_base (356)..(356): a, c, t, g, unknown or other
  misc_feature (356)..(356): n is a, c, g, or t
  modified_base (393)..(393): a, c, t, g, unknown or other
  misc_feature (393)..(393): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttggtccncaggctccgagggaggggttgcgaggtggtcgtcggggattggaagtgagtggtnccacacactacgcacgacgtccggtgacgggggcccncttacgactcgatcctaccagacgacgacttaaccgaaaacacagtagaaatctagactaaagtgtaaccagccctacgacgacccggaccggaacggaaccgaccgggtacccgttaccgttaaccgttccgttacggtacggaaaccggtaaaaccgttaacccgtttaccgtttaaacggtttttccgggggccccggtaccgggtacccgtaccggttaaccggtccgggggtacccgtaaccccggggg

SEQ ID NO: 357102 - DNA, 654 bp, Homo sapiens
  misc_feature: GZ8MTXP02IC24O.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctgacactctcctgtgcagcctctggattcacagtcagcagcaatgccatgaggttgggtcccgccgaggctccgaggggaaggggttgcgaggtggggtctcggggatttgggaagtgagtggtgccacacactacgcagactcccggtgacgggggcccgcttcactcatctccagagacgattaccgaaaacacagtagaaatctagactaaaatcgtaacacgaccctacgaacgccggacccggaacggaacccgtaaccggggcccgttaccgttaaccctttccgtacggttcggaaccggtaaaacgtacccgtttacctttaaacggttttttccgggggccccggttaccggggaccccggtaaaccggtttaaccggtccgggggtacccgaacccggggg

SEQ ID NO: 357103 - DNA, 649 bp, Homo sapiens
  misc_feature: GZ8MTXP02HKQ1M.22.36.D03.1.454.CMB.2.raw
  modified_base (313)..(313): a, c, t, g, unknown or other
  misc_feature (313)..(313): n is a, c, g, or t
  modified_base (432)..(432): a, c, t, g, unknown or other
  misc_feature (432)..(432): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggtctaattttaaaaggtgtcaagtgtgcggtgaaggtattggagtcgtgggggagcttgggtacgagggccggggggtccctgaccactctcctgtcgcacgcctctggattcacagtcagcagcaatcgccagtgaggttcgggcccnccgaggcctccggaaggggaaggggttgacgtagggttggggtcgtcggggtatttggggaaagttgagtcggtcgcccaactacaccgtacgcagaccgtccggtaggacggggtccncttacgactcactcctaccgagacgtaacgtaacttaaccgaaaacacgagtacgaaaatcctagaacctaaagtcgtaacacgtccacgacgccgaccgaggaccgaccggccgttacctacgttcgtcggtacgaaccgaaaacgtccgtttacgtttacggtttcgggcccgtacgggtacccgtacgtaccggtccggggaccgaacccgggg

SEQ ID NO: 357104 - DNA, 599 bp, Homo sapiens
  misc_feature: GZ8MTXP02FOVB9.22.36.D03.1.454.CMB.2.raw
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccaggggaaggggttgcagtgggtctcggggattggaagtgatggtgccacacactacgcagactccgtgaggggccncttcatcatctccagagacgattccgaaaancagtgaatctgcaaatgtacagcctcagcgccgaggacacggccgtctacttctgtgcgaaagcctctattttgggccgcggccgacctacgtgggcaggcacctggtcaccgtctcttcagcctccaccaacgggcccagtccggtccttcccccgtggcccgcccctgccctccgacggacgccacccgtccgacggacgccgaccgacgcccggccccgtgggggtccttcggccccgtgggttaccgaaaacgggtaccttaacccgtttcccgaaccggtccgttaacgtcggttaccttggacggcggggtccctggggaccgaacgggccgaccgacgtacgg

SEQ ID NO: 357105 - DNA, 566 bp, Homo sapiens
  misc_feature: GZ8MTXP02HJP01.22.36.D03.1.454.CMB.2.raw
  modified_base (303)..(303): a, c, t, g, unknown or other
  misc_feature (303)..(303): n is a, c, g, or t
  modified_base (397)..(397): a, c, t, g, unknown or other
  misc_feature (397)..(397): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtatggagtcgtgggggaggcttgggtacaggccgggggggtccctggacactctcctgtgcagcctctggattcacagtcagcagcaatgccatgagttgggccncaggctccgaggggaggggttgcgaggtggggtcgtcggggattgggaagtgacgtggcgccacacactacgcagactccggtagacggggccncttcgatcactctccagacgacgataccgaaaacacgagtagaaatcagacaaatgtacagcctacacgcgccgaggaccacggccgtactacgtcgtacgtcgacgaaacgtacctcttaacgttttcgggcccgacggtcccgaacgtccgtcggggacccgacggg

SEQ ID NO: 357106 - DNA, 635 bp, Homo sapiens
  misc_feature: GZ8MTXP02JSQN5.22.36.D03.1.454.CMB.2.raw
  modified_base (398)..(398): a, c, t, g, unknown or other
  misc_feature (398)..(398): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtccctgacactctcctgtgcagcctctggattcacagtcagcagcaatgccatgagttgggccgccgaggcctccgaggggagggttgcaggtgggtctcggggattggaagtgagtggtcaccacacactacgcagaccgtccggtaggacgggggcccncttcgatccaactctacccgagagacgtacttaacccgaaaactacgagtacgtaaatccgtaagactaaagtcgtaacaacgtccgtacgacgccgaccggaacggaccgaccggtcccgttaccgtaccgtttctacggtacgaaccgtaaacgtacccgttacgtttaacgtttttccggggcccgtaccgggtacccggtaccgttaccggccgggggtacccgtaaccgggg

SEQ ID NO: 357107 - DNA, 614 bp, Homo sapiens
  misc_feature: GZ8MTXP02JNUY9.22.36.D03.1.454.CMB.2.raw
  modified_base (314)..(314): a, c, t, g, unknown or other
  misc_feature (314)..(314): n is a, c, g, or t
  modified_base (351)..(351): a, c, t, g, unknown or other
  misc_feature (351)..(351): n is a, c, g, or t
  modified_base (368)..(368): a, c, t, g, unknown or other
  misc_feature (368)..(368): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaacccaacgagtgactagttgggtacttttgactctgtctcctggtaccaacaacaccagaccaaaccccccatcatcattatgtntcactcgtccgcctcgaggagtctcctcatcgcttcncaggcctaccaagtccngtacaacgacggccctactacctaaaccctatcctcgtcgggtctcccgtagtttacggaggtacgagttccttactttaattaccgtgtacctagtttacctttaaaagtacggccgtaccctacgttccttcgggttcggttttccgggacgggacggtccgtaaacccgtaaggtccgtacccgttcccgtacggtaccaacgccccgaacggtccctaccgtcccccctcggtacttccccg

SEQ ID NO: 357108 - DNA, 576 bp, Homo sapiens
  misc_feature: GZ8MTXP02GPN2I.22.36.D03.1.454.CMB.2.raw
  modified_base (281)..(281): a, c, t, g, unknown or other
  misc_feature (281)..(281): n is a, c, g, or t
  modified_base (453)..(453): a, c, t, g, unknown or other
  misc_feature (453)..(453): n is a, c, g, or t
  modified_base (485)..(485): a, c, t, g, unknown or other
  misc_feature (485)..(485): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctggacactctcctgtgcagcctctggattcacngtcagcagcaatgccatgagttcggtccgccaggctccgaggggaaggggttgcgaggtgggtcgtcggggatttgggaagtggattgggtcgccacacacgtacgcaagaccgtccggtggacggggccgtcgttcaactcatcctccaagacgacgacttaccgaaaacncagtacgaatctgacaaatgtaacacgacctnagcgaccgacggaccgacggcctacgtacttcgtcgtacgacgtaaacgtaccttacgtttacgtttcgggcccgtcggtacccgtaaccg

SEQ ID NO: 357109 - DNA, 672 bp, Homo sapiens
  misc_feature: GZ8MTXP02JXR0Q.22.36.D03.1.454.CMB.2.raw
  modified_base (156)..(156): a, c, t, g, unknown or other
  misc_feature (156)..(156): n is a, c, g, or t
  modified_base (225)..(225): a, c, t, g, unknown or other
  misc_feature (225)..(225): n is a, c, g, or t
  modified_base (260)..(260): a, c, t, g, unknown or other
  misc_feature (260)..(260): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgagggaaggggttncaggtgggtctcgggggattgggaagtgatgggtgccacacactacgcagactccggtggacggggccncttcatcatcctccagagacgtattaccgaaaacncagtagaatctgacaaatgtacacgcctacgagccgaccggacggacaccggccgtctacttcgtgtgacgaaacgtccttcttagttttcgggccgcggccgaccgtaccggtcggggaccacgggccacccgtggtcccgtaccgtcttccgttccgacgtccctaccgaccgaccgggaccctacgttcccggtcccgttcccccgtcggccccgtccccgtcgtacccgtacccgacgggtaccgtcccgacccgtacccgggacggaccgaccgaacccggaccggcccgggtccccggttcggggccttccgggccgttacgggtacgaaacgggttacctaccgttacccgacggtacgttacgtcgttccggaggcggtcggcgtacgggacaggccacgagtg

SEQ ID NO: 357110 - DNA, 593 bp, Homo sapiens
  misc_feature: GZ8MTXP02F8SVE.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcacgcctctggattcacagtcagcagcaatgccatggagttcgggtccgccgaggcgtccgaaggggaaggggttgcgaggtgggtcgtcggggattggagtgagtgtgccacgcaacgtacgcgaacgtacgtccggtgggacggggtccgtccgttcacttacgcttcctccgaagacgaacgtaacgttacccgaaaacgacgtacgtagaactcgtacgacgaaatcgacgacgcctacgacgcgaccggacgacgaccggtccgtctacgttctacgtcgacgtaacgtcctacgttacgtttcggccggtcggtaccgtaccgg

SEQ ID NO: 357111 - DNA, 611 bp, Homo sapiens
  misc_feature: GZ8MTXP02IQ2FV.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatggagttgggtccgccaggctccgaggggaggggttgcgaggtgggtcgtcggggattgggaaagtgagtgggtgcccgacaccactacgcagacctcccggtgacgggggcccgtacgttccatcatcctccgagagacgacttaccgaaaacacagtacgaaatcctgaactaaatcgtaacacgcctcgacgcgaccgaggaccgacggcccgttactacgtttctggtacgacggtaaacgtacccttcgtttaacgtttttcgggccccggtccgggtacccggtaccgtaccggttcgggggacccgtaccggggg

SEQ ID NO: 357112 - DNA, 637 bp, Homo sapiens
  misc_feature: GZ8MTXP02F7XO0.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcagcctctggattcacagtcagcagcaatgccatgagttgggtccgccgaggctccgaggggtaaggggttgcgaggtgggtcgtcggggattggggaagtggacgtggtcgccacacacctacgcagaccgtccggtaggacgggggccctcgttacatcactctaccgagacgacgtacttaacccgaaaactacgaacgtagaaacttcgtacgaactaaaagtcgtaaccgacgccctacgacgcccggacggaacggaccgaccggtcccgtacctaccttcgtcgtacgaccggtaaaacgtaccttacggtttacgttttccggggacccgtcggggacccgtacgtaccggtacggggacccgtaaccgggg

SEQ ID NO: 357113 - DNA, 690 bp, Homo sapiens
  misc_feature: GZ8MTXP02IZZH2.22.36.D03.1.454.CMB.2.raw
  modified_base (311)..(311): a, c, t, g, unknown or other
  misc_feature (311)..(311): n is a, c, g, or t
  modified_base (435)..(435): a, c, t, g, unknown or other
  misc_feature (435)..(435): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttggtacgaggccggggggtccctgacactctcctgtcgcagcctctggattcacagtcagcagcaatcgccatgaggttgggtcccgcgnggcctcgaaggggaggggttgcgagggttcggggtcgtcggggtagttgggaaagtggagttggggtcgacccaacaccgaaccttacgccgaacgtccgtaccgggtgggaacgggggtcccncgtttccaacgtccacgttccctacccgaaagtaacgaacgtaacgttaacccgaaaaacgtaaccgaagttaggaaacttacctaggaaacctaaagtacgtaaccgaacgtccctacgacggccggaccgaacggacccgaccgggtccctacgttacttcgtacgtacgaaccgaaacgtaccgtttaccgtttacgttttccggggcccgacgggtacccgaccgttaccggtacgggggaccacccgggg

SEQ ID NO: 357114 - DNA, 599 bp, Homo sapiens
  misc_feature: GZ8MTXP02JDL8U.22.36.D03.1.454.CMB.2.raw
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (309)..(309): a, c, t, g, unknown or other
  misc_feature (309)..(309): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcactgggaccaanagtgactattggtctttgactctgtctcctgtaccaacaaccaccacgacccaaacccccatcatctattatggtntcactcgtccgccctgaggtactcctcctcactcgcctttcaccaggcctcgaaagtccgtacgacctaacgccggtaccctacccctaaaccacttccgtcgtacgggtacctacccgtaggtttacggacggtacgtagttacttacttactttacgtcgtacttaacggttttaccttaaagttcggcccgttacctacgttccgtacggttcggtttacggcggtacgacgtacgagtcgaccgtccgtcgtcacgccgacgtcgtaccgcccctcgctactcccg

SEQ ID NO: 357115 - DNA, 648 bp, Homo sapiens
  misc_feature: GZ8MTXP02HPZ0Q.22.36.D03.1.454.CMB.2.raw
  modified_base (308)..(308): a, c, t, g, unknown or other
  misc_feature (308)..(308): n is a, c, g, or t
tcagacatacgcgtcacgaccggtgctcgatttagctgcgtcacgatctctcgttgggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcattccctgcactgggaccaacagtgacatttgggtcttttgacttctgtctcctgtaccaacaacaccacgacccaaacccccatcatctattatgtntcactcgtccggcctcgagtcgtctctccgactcgtcttcctcgacggtctaccgtaagttccgtacggacccaaaccgacccggtccccttaacccctaaacctacttcccgtcgttcgggcccttccgacgtccgtaggaaggagtaggacggtcttagtactttactttacgtgtaccttactctaattacgtcgacggacggacggtacctaaacgtttcggtttcgggggttcggttaccggggtacggggaacgggtaacccgtaggtccgtacgggaacccgtttccggtaaacgggttcccgaaccgtacccggaacggtccgtcccccggg

SEQ ID NO: 357116 - DNA, 584 bp, Homo sapiens
  misc_feature: GZ8MTXP02G5R23.22.36.D03.1.454.CMB.2.raw
  modified_base (370)..(370): a, c, t, g, unknown or other
  misc_feature (370)..(370): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggctattttaaaaggtgtcaagtgtgcggtgaaggtattggagtcgtgggggagcttggtacgaggccggggggtccctgacactctcctgtcagcctctggatcacagtcagcagcaatgccagtgagttggccgcaggctccgagggaacgggttgcgaggtgggtcgtggggatgggaagtgagtggtcgaccaacncaactacgcagacctccgtgacgggccgcttcatcatcgtaccagacgacgacttaccgaaaacacagtaagaaactctagactaaaatcgtaacgactccacgacgaccgaccgaacgacgaccggacccggtataccgttccgtgtacgaacgaaacgtaaccgtaccgtttaagttttcggggaccgaccggtacccgacgttaaccgggg

SEQ ID NO: 357117 - DNA, 568 bp, Homo sapiens
  misc_feature: GZ8MTXP02JDQMV.22.36.D03.1.454.CMB.2.raw
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
  modified_base (311)..(311): a, c, t, g, unknown or other
  misc_feature (311)..(311): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccncttcatcatctccagagacgattaccgaaaancagtgaatctgcaaatgtacagcctcagcgccgaggacacgccgtctacttctgtgacgaaancctcttagtttttgggccgcggccgaccgtacgtcggggccacgggcacccgtggtccaccgtcgttcttccacgtcctccacccgaacgggcccacgtccggtccttcccccgtcggccgcccctaggccctccgacgacggtccaccctcggacgacgccgacgacgccgggcccgtcgggctcgccgtaggtccaaggtacctactcccgacgcgtacgtcgtcgtcgcggtcggctgggaccaaggcgcagtg

SEQ ID NO: 357118 - DNA, 658 bp, Homo sapiens
  misc_feature: GZ8MTXP02H867Q.22.36.D03.1.454.CMB.2.raw
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (398)..(398): a, c, t, g, unknown or other
  misc_feature (398)..(398): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctgccctgacccagcctgcctcgtgtctggatcatctggacagtcgatcagctatttccngcacgtggaccaanagtgactagtttcgggtctttcgactcgtcgtctccgtacggtaaccaaaccaacaaccccgaacggaccccaaaaccccccaactaccactacctaatttagtcggttacgtcctaccgttccggtccggcccctagacggtactctccctacactcgtcttcncgacgcctaccgaaagtcctacggacctaacgaccgtcccctaccctaaaccacttccgtcgtcggtcctacgtagttacgaacgtacgtacgtacttaacgtttattacgtagtacttaacgttacgttaaagttcggacctacgtacttcgttcgggttcggtttcgggacgttacggacgtacggtaacgtccgtacccggttcgtccggttaccacgtaaccgtacgccgtcccgccccgtcgtcccgtactcccg

SEQ ID NO: 357119 - DNA, 699 bp, Homo sapiens
  misc_feature: GZ8MTXP02F55RG.22.36.D03.1.454.CMB.2.raw
  modified_base (217)..(217): a, c, t, g, unknown or other
  misc_feature (217)..(217): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcacgtgggaccaacagtgacattgggtctttgactctgtctcctgtaccaacaacaccagaccaaacccccactcactactattatgtgtcactcgtcgcctcaggagtctctcctactcgtcttctcacgctcctaacgtctcggaccaacaaccggtccctaccctaaacctacttcctccgtacgggtcctacccgttacgttcggtaacggtacgtaacgttacttaactttaacgtttaccgttacgtacgtttaccgttttaacccgttttaaaacgttaacggtccccgttaccctacctttaccgtttaccgggtttcgggtttaccggggtacggggtaaccggtaccgtaacccgggtaaacggtacccggtaacccggttcccgtacgggtaccgaccggtaccccggtaacggtcccgttcccggtaccccccgttccgggttacccacccgtttaccgtttcccccgg

SEQ ID NO: 357120 - DNA, 552 bp, Homo sapiens
  misc_feature: GZ8MTXP02FLP25.22.36.D03.1.454.CMB.2.raw
  modified_base (218)..(218): a, c, t, g, unknown or other
  misc_feature (218)..(218): n is a, c, g, or t
  modified_base (546)..(546): a, c, t, g, unknown or other
  misc_feature (546)..(546): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgactattgggtcttttgactctgtctcctggtaccaacaacacccagaccaaaccccccactcatcatttatggtgtcactcgtcggccctcaggagtctcctcatcgcttctcaggcctccaagtctggacaacgaccgccctaccctaacactctcgtcgggctccagtttgaaggtacgagtcttaacttacttactgactagtttacctttaaaagttcggactacctacgttcgtcgttggtttcggcggtacgcacgagtcgaccgtccgtacggtcacgccgaggtcctcgccccctggtaccncttccg

SEQ ID NO: 357121 - DNA, 533 bp, Homo sapiens
  misc_feature: GZ8MTXP02FE9N2.22.36.D03.1.454.CMB.2.raw
  modified_base (387)..(387): a, c, t, g, unknown or other
  misc_feature (387)..(387): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccagggaagggggttgcagtggggtctcggggattggaagtgatggtgccacacactacgcagactccgtgaggggccncttcatcatctccagagacgattccgaaaacacagtgaaatctgcaaatgtacagcctcagcgccgaggacacggccgtctacttctgtgcgaaaacgacctcttaattttcggggccgtcggccgactacgcggggcccacgggg

SEQ ID NO: 357122 - DNA, 686 bp, Homo sapiens
  misc_feature: GZ8MTXP02GBAOV.22.36.D03.1.454.CMB.2.raw
  modified_base (309)..(309): a, c, t, g, unknown or other
  misc_feature (309)..(309): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggtcttaattttaaaaaggtgtacaagtgtgcggtgaaggtattggagtcgtgggggagcttggtacgaggccggggggtcctgacactctcctgtgcagcctctggattcacagtcagcagcaatgccatgaggttcgggtcccnccgaggcctccgaaggggtaaggggttgcgtagggttcgggtcggttcggggtattggggaaagtggagtgggtcaccacaacacgtacgcgacgaccgtccggtaggacgggggccctcgttcactcaactctaccgagaacgacgaacgttaaccgaaaacactagacgaatactagaactaaatacgtaaccacgacccacgaacggccggacccggaacgggaacccgaccggggtacccttaccgtaaccgtttcgtacggtacggaaaccgtaaaaccgtaccctttacggttttaacggttttaaccgggggcccgtacccgggtacccggtaacggtttaaccgggtccgggggacccgtaacccgggg

SEQ ID NO: 357123 - DNA, 546 bp, Homo sapiens
  misc_feature: GZ8MTXP02IO5QM.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccgggggggtccctgacactctcctgtgcagcctctggattcacagtcagcagcaatgccatgagttgggtccgcaggctccgaggggaggggttgcaggtggggtctcggggattggaagtgatgggtgccacacactacgcagacctccggtgacgggggccgcttcatcatctccagagacgacttaccgaaaacacagtgaatctagacaatagtacagcctcgacgcgaccggagacgacggccgtctacttctcgtgacgaacgacctcttacgtttggccgtcggtccgacgtacgtcgggaccgtacggg

SEQ ID NO: 357124 - DNA, 664 bp, Homo sapiens
  misc_feature: GZ8MTXP02JTKOL.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcagcctctggattcacagtcagcagcaatcgccagtgtaggtttcggggtcccgccgagggcctccggaaggggtaacggggttgcgagggtgggtcgtcggggatttgggaagtgagtggtcgaccacacgacgtacgcgaacgtaccgtccgggtaggaccgggggtccctctttaccgattccacttcccacccgaggaacgacgtacgttaaacccgaaaacacgagtagaaactctaacgacctaaaagtgtaaccgaacgtccgtacgacggaccgaccggacggaccgaccgggtccttaccgtaccgtcgtacggtacgaacgtaacgtaccgttacgtttacggtttccggggcccgtaccgggtaccgtaccgtacggtccggggaacgtcccgggg

SEQ ID NO: 357125 - DNA, 595 bp, Homo sapiens
  misc_feature: GZ8MTXP02HSILN.22.36.D03.1.454.CMB.2.raw
  modified_base (232)..(232): a, c, t, g, unknown or other
  misc_feature (232)..(232): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaangtgacattgggtctttgactctgtctcctgtaccaacaacacccagccaaaccccccactcatcattatgtgtcactcgtcggccctcaggacgtctccctcactcgcttctcaggcctcaaagtctgacaacacgccctacctaaccatctctggctccgagttcgagacagtctacttattactgtactagtttaccttaaagttacggctcctaacgttcctggttcgggtttttccgggacgggttacggtaccgtaacccggaaagttccggtaacccgtcccgttccgggttaccacggaaccccgtaaacgggccttcccggaccccccgttccgggtacccttaaccgttccccg

SEQ ID NO: 357126 - DNA, 629 bp, Homo sapiens
  misc_feature: GZ8MTXP02H5HFO.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttggtacgaggccggggggtccctgacactctcctgtgcagcctctggattcacagtcagcagacaatcgaccatggacggtttcggggtcccgccgaggcctacccggaagggggtaaggggtttggcgtagggttcggggtcgtacgggggtagtttgggaaaggtgagtggggtcgaccacacacgtacgcacgacctccggtggacgggggcccgcttcacgtcactctccgaagacgaacgacttaaccgaaaacacgagtagaaatctagactaaatagtacacgcctcgacgcgaccggacggacgaccggcccgtctacttcctcgtagtacgaaacgtaccttcgttacgttttccgggcccgtaccggtccggaccgtaccgtcggggtaccgaccggg

SEQ ID NO: 357127 - DNA, 601 bp, Homo sapiens
  misc_feature: GZ8MTXP02GAS8C.22.36.D03.1.454.CMB.2.raw
  modified_base (303)..(303): a, c, t, g, unknown or other
  misc_feature (303)..(303): n is a, c, g, or t
  modified_base (345)..(345): a, c, t, g, unknown or other
  misc_feature (345)..(345): n is a, c, g, or t
  modified_base (379)..(379): a, c, t, g, unknown or other
  misc_feature (379)..(379): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctctggtaccaacaacaccagaccaaacccccatcatcatttangtgtcactcgtccggcctcgaggacgtctcctcatcgcttcncagctcgaatctgacaacacgccctaccctaacnctactctgggcctcgagtttgaggtacgacgtcttacttattacctgtactagtttacctttaaagttacggccgtacctacgttcgttccggttagggttttccgggcggtaacggtcccgaaacggtacggttaccgacccggttccgtccgggttaccaccggccccggaaacggtcccttacccggtcccccccgtcggttaccctacctttccccgg

SEQ ID NO: 357128 - DNA, 640 bp, Homo sapiens
  misc_feature: GZ8MTXP02IF0YS.22.36.D03.1.454.CMB.2.raw
  modified_base (394)..(394): a, c, t, g, unknown or other
  misc_feature (394)..(394): n is a, c, g, or t
tcagacatacgcgtcacgaccggtgctcgatttagctgcgtcacgatctctcttgggggagagaggagcccagccctaggattttcaggtgttttcatttggtgatcaggactgaacagagagaactcaccatggagtttgggctgaagtggcctttgcttgtggctattttaaaaggtgtcaagtgtgcggtgaaggtattggagtcgtgggggaggcttggtacaggccggggggtccctgacactctcctgtgcagcctctggattcacagtcagcagcaatgccatgagttgggccgcaggcctccgaggggagggttgcgaggtgggtctcggggattgggaagtgatggtgccacacacctacgccagccgtccggtgacgggggccnctttcacttcacttcctaccagaacgacgtaacttaaccggaaaaacaccgaagtaggaaatccgtagaactaaagtgtaccacgcctacgaaggccgaccggacggacctaccggggaccccttacgttacctttccgtggttacggaaccgtaaaacggtaaccctttcgtttaaacggttttcgggggccccgtaccggggaccccggtaacgtaccggggttcgggggacccgaaccggggg

SEQ ID NO: 357129 - DNA, 625 bp, Homo sapiens
  misc_feature: GZ8MTXP02GMSUR.22.36.D03.1.454.CMB.2.raw
  modified_base (364)..(364): a, c, t, g, unknown or other
  misc_feature (364)..(364): n is a, c, g, or t
  modified_base (393)..(393): a, c, t, g, unknown or other
  misc_feature (393)..(393): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacagccgggggggtccctgacactctcctgtgcagcctctggattcacagtcagcagcaatgccatgagttgggtccgccaggctccgaggggaaggggttgcgaggtgggtcgtcggggattggaagtgactggtgccanacactacgcagacctcgtgacgggggccncgttcgatcactctaccgagacgacgacttaccgaaaacacagtagaaattccaggacaaaagtcgtaacgacgtaccctacgaacggccggtacccggagggaacccgtaccggggcccgttaccgtaacctttcgtcggtaggaccgtaaaacggacccttcgtttaaaggttttcggggcccgtaccgggtcccgaaccgttccgggtaccggggacccgtaccggggg

SEQ ID NO: 357130 - DNA, 622 bp, Homo sapiens
  misc_feature: GZ8MTXP02JZ2IK.22.36.D03.1.454.CMB.2.raw
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgaggggaaggggttgcaggtgggtctcggggattggaagtgatggtgccacacactacgcagactccggtgaggggccncttcatcatctccagagacgattaccgaaaacncagtgaatctgcaaatgtacagcctcagcgccgaggacacggccgtctactctgtgcgaaagcctctagtttttcgggccgtccggccgacccgtacgtggggccgagggccacccgtggtcaccgtctccttcacgccctccaccgaacggccccatccggtcccttcccccgtcggcccgcccgtcgcctcccgagtcgaccacccgtccgacgcgcaccgacgccggcccgtcgggctcggcccgttgggtacccgaaacggtacccgttaaccgttcccgaaccggtaccggttacgttacggttccgtacggtaccgggcccggggtacgtacggggaccgaaaggggcccgacgaagtaacg

SEQ ID NO: 357131 - DNA, 606 bp, Homo sapiens
  misc_feature: GZ8MTXP02FZMA0.22.36.D03.1.454.CMB.2.raw
  modified_base (269)..(269): a, c, t, g, unknown or other
  misc_feature (269)..(269): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggagcttggtacaggccggggggtcctgacactctcctgtgcagcctcnggattcacagtcagcagcaatgccatcgagtttcgggtccgccaggcctccgaggggaaggggttgcgtagtgggtcgtcggggattgggaagtgatgggtgccacacactacgcagactccggtgacggggcgacgttcatcagtctcagagacgtaattaccgaaaacaccaagtacgaaattcgtacgactaaaacgtgttaaccacggtccctacgacggccggaccggtacggaccgtaaccgggccgttacgtaccgttcgtacgtacggaacggaaacgtaccttaccgttacggtttttaccggggccggtccggtacccgtaaccggg

SEQ ID NO: 357132 - DNA, 522 bp, Homo sapiens
  misc_feature: GZ8MTXP02IMRHN.22.36.D03.1.454.CMB.2.raw
  modified_base (218)..(218): a, c, t, g, unknown or other
  misc_feature (218)..(218): n is a, c, g, or t
  modified_base (230)..(230): a, c, t, g, unknown or other
  misc_feature (230)..(230): n is a, c, g, or t
  modified_base (252)..(252): a, c, t, g, unknown or other
  misc_feature (252)..(252): n is a, c, g, or t
  modified_base (290)..(290): a, c, t, g, unknown or other
  misc_feature (290)..(290): n is a, c, g, or t
  modified_base (304)..(304): a, c, t, g, unknown or other
  misc_feature (304)..(304): n is a, c, g, or t
  modified_base (319)..(319): a, c, t, g, unknown or other
  misc_feature (319)..(319): n is a, c, g, or t
  modified_base (323)..(323): a, c, t, g, unknown or other
  misc_feature (323)..(323): n is a, c, g, or t
  modified_base (361)..(361): a, c, t, g, unknown or other
  misc_feature (361)..(361): n is a, c, g, or t
  modified_base (376)..(376): a, c, t, g, unknown or other
  misc_feature (376)..(376): n is a, c, g, or t
  modified_base (408)..(408): a, c, t, g, unknown or other
  misc_feature (408)..(408): n is a, c, g, or t
  modified_base (432)..(432): a, c, t, g, unknown or other
  misc_feature (432)..(432): n is a, c, g, or t
  modified_base (481)..(481): a, c, t, g, unknown or other
  misc_feature (481)..(481): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactggaccanagtgactattggtctttgactntgtctcctgtaccaacaacaccagaccaaaccccccancatcatttatggtntcactcgtcgccctnaggntctcctcatcgcttctcaggctccaagtctgaccaacncgccctaccacatcntggctcgtagttgagacgatctacttattacngtctagtttcctttaaaatcggcncctactcgttcgttggtttcggcggtacggcaccggagtcgaccgtccncggtcacggcccaaggcctccgcccttcggcctacgttccg

SEQ ID NO: 357133 - DNA, 591 bp, Homo sapiens
  misc_feature: GZ8MTXP02HF3G2.22.36.D03.1.454.CMB.2.raw
  modified_base (327)..(327): a, c, t, g, unknown or other
  misc_feature (327)..(327): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcagcctctggattcacagtcagcagcaatgccatgagttcgggcccgcgaggctccgaggggaggggttncgaggtgggtcgtcggggattggaagtgagtggtcgaccacgacacgtacgcacgactccggtggacggggccgtcttcgatcatcctccgagacgacgacttaaccgaaaactacgaagtcaaatcctagactaaagtcgtacaagccctagacgccgaccggacgaccgaccggcccgttactacgtcgtgtacggaacgaaacgtccttcgtttagtttccgggccgtacgggaccctacgtacggtcgggacccgacggg

SEQ ID NO: 357134 - DNA, 681 bp, Homo sapiens
  misc_feature: GZ8MTXP02F1OAA.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctctggtaccaacaacacccaggaccaaaccccccaactcatcatttatggtgtcactcgtcggccctcgaggagtctcctcatcgcttctcaggtctccaagtctcggcaaacgaccggcctaccctaaaccacttcctcgtcgggtcctcccgtaggtttcgaacgggacgtacgtactttaacctttaactttacctacggtaccttacggttttaaccctttaaaagttaccggtaccgtaccctaaccttccgttccggtttgggtttttccggggaccgggtaacgggtacccgtaacccggtaaacggttacccggtaaccccgttcccggttaacccgggttcccgaaccggaacccccgtaaacgggtcccgtacccggtccccccgttaccgggtccctaacctttccccgg

SEQ ID NO: 357135 - DNA, 634 bp, Homo sapiens
  misc_feature: GZ8MTXP02JHHDG.22.36.D03.1.454.CMB.2.raw
  modified_base (266)..(266): a, c, t, g, unknown or other
  misc_feature (266)..(266): n is a, c, g, or t
  modified_base (307)..(307): a, c, t, g, unknown or other
  misc_feature (307)..(307): n is a, c, g, or t
  modified_base (326)..(326): a, c, t, g, unknown or other
  misc_feature (326)..(326): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggtcttattttaaaaggtgtcaagtgtgcggtgaaggtattggagtcgtgggggagcttgggtacgaggccggggggtcctgacactctcctgtgcagccctntggattcacagtcagcagcaatgaccatgagttgggtcctnaggctcgaggggagggttncgagtgggtctggggtattaggaaggtgacgtggtcgacccgactacacgttacgcgaacgtaccgttccgggtaggaccgggggcctccttacgaactcctaactccgtaccgaaggtaaagacccgtaacttaaacccggaaaaacaccgaagtacgaaatcgttacgaactaaaagttgtaaccgaacgtccagacgccgtacgaggaccgacgtccgtctacgtttcaggtcaacggtaactacccgtagtttacgtttcggggcccgacgggtcccgaacgtccggtcggggactacccgggg

SEQ ID NO: 357136 - DNA, 754 bp, Homo sapiens
  misc_feature: GZ8MTXP02GBDC1.22.36.D03.1.454.CMB.2.raw
  modified_base (307)..(307): a, c, t, g, unknown or other
  misc_feature (307)..(307): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaggtgtcaagtgtgcggtgaaggtattggagtcgtgggggaggcttgggtacgaggccggggggtccctgacactctctgttcagcctctggattcacagtcagcagcaatgccatgagttgggccncaggctccgaggggaaggggttgcgtaggtggggtcgtcgggggtattggggaaagtggagtggggtcgcccaacgactaccgtacggacaacggaccgtcccggtggggacgggggcccgtcgtttaccgacttccaacttcccgtacccgaaggtaacggtaaccggtaacttaaaccccggaaaaaactacccggtaaaggttacggaaacttaccgttaaggaaccctaaaaagttacggtaaaccacggtacccgttaccgacggaccccggaacccgggtaaacgggaaccccgtaaacccgggggtccccgtttaccgttaaacccgtttccggttacggttaaccggaaccggtaaaaccgtaaccccgtttaccgtttaacggtttttcccgggggccccgttacccggggacccggttaacccgtttaacccggggg

SEQ ID NO: 357137 - DNA, 694 bp, Homo sapiens
  misc_feature: GZ8MTXP02JB0L5.22.36.D03.1.454.CMB.2.raw
  modified_base (308)..(308): a, c, t, g, unknown or other
  misc_feature (308)..(308): n is a, c, g, or t
  modified_base (374)..(374): a, c, t, g, unknown or other
  misc_feature (374)..(374): n is a, c, g, or t
tcagacatacgcgtcacgaccggtgctcgatttagctgcgtcacgatctctcttgggggagagaggagcccagcccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcttggtacgagggcccggggggtccctgacactctcctgtgcagcctctggattcacagtcagcagcaatgccagtgagttgggtccnccgaggctaccgaggggtagggttgcgaggtgggtcgtcggggattgggaagtgagtggcgccacncacctacgcgaacgtaccgtccgggtaggaccggggtccctaccgttcaacttcgacgttcctacccgaaggaacgtaaaccgaccgttaaacccggaaaaactaaccgtaagtacgtaaactcgtagaaccgtaaaattcgtaaccgacgtacccgtcgaacggccgaacccgggaacggaacccggtaccggtaccccgttccttaacgtttcccggtaggtaccggaaaccgtaaaccggttaccttccgtttaacggttttccggggcccggaccggtacccggtaaccgttaccggtccggggaccgtacccggg

SEQ ID NO: 357138 - DNA, 714 bp, Homo sapiens
  misc_feature: GZ8MTXP02JO6IT.22.36.D03.1.454.CMB.2.raw
  modified_base (313)..(313): a, c, t, g, unknown or other
  misc_feature (313)..(313): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctcctggtaccaacaacacccaggaccaaacccccccaatcatcatttatggtntcactcgtcggccctcaggagtctcctcatcgcttctcacgctccaagtctggcaacaccggccctaccctaaaccacttcctcctcggggcccttacccgtaggttttcgaacgggtaccgtacggttaccttaactttactttaaactcggtaccttaagggttttaccccttttaaaaagtttacgggaccgtacccctaaccgttccgtttccgggtttcggggtttttccgggaccgggtaaacggggtccgtaaacccgggtaaaacgggttccggtaaaccccggtttcccgtaaccgggggtttcccaaaccgggtaacccccgtaaaacggggtcccgttacccgggaccccccccgtttccgggggttacccctaacccgttttcccccgg

SEQ ID NO: 357139 - DNA, 720 bp, Homo sapiens
  misc_feature: GZ8MTXP02F2YJD.22.36.D03.1.454.CMB.2.raw
  modified_base (217)..(217): a, c, t, g, unknown or other
  misc_feature (217)..(217): n is a, c, g, or t
  modified_base (250)..(250): a, c, t, g, unknown or other
  misc_feature (250)..(250): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgagggaaggggttgcagtgggtctcggggattggaagtgatggtgccacacactacgcagactccgtgagggccncttcatcatctccagagacgattaccgaaaacncagtgaatctgacaaaatgtacagcctcagccgccgaggacacggccgtctacttctgtgacgaaacgtaccctcttaagtttttcgggccgtcggaccgaccgttaccgtcggggccacggggccaccccgttgggtccacccggtctccttccacgtccctaccgaacccgaaacggggccccaacgttcccgggtccccttccccccgtgggtcccgcccccgttgccccttacccgaaaggccggacccaaccccgtcccggaacggacgacccgaaccgaccgggccccggtcccccgttcggggcccgtttcggaccccgttggggtaacccgtaaaacgggtaaccccttaaccgtttccccgaacccggtacggtttaacgttcggtttacccgggtacgggtaccggggtccggggtaccggtaccgggaaccggaaccggggtccgtaacgtaacgtacg

SEQ ID NO: 357140 - DNA, 748 bp, Homo sapiens
  misc_feature: GZ8MTXP02JTGUK.22.36.D03.1.454.CMB.2.raw
  modified_base (303)..(303): a, c, t, g, unknown or other
  misc_feature (303)..(303): n is a, c, g, or t
  modified_base (463)..(463): a, c, t, g, unknown or other
  misc_feature (463)..(463): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcagcctctggattcacagtcagcagcaatgccatgagttgggtccnccgaggctccgaggggaaggggttgcgaggtggggtcgtcggggtattgggaagtgagtgggtcgcctacacactacgcagaccgtccggtaggacgggggcccgtcttccgactccaatccgtacccaggaacgaccgtaacttaacccggaaaaaacncgtaaacgtagtaaacttccgttaaggaacctaaaagtttacgtaaaccgaaccggtaccccttaccggaacgggaccccgggaacccggaacggggaaccccgaacccgggggtcccccgtttaccgtttaacccgtttcccgtagggttaaccggaaaccggtaaaaaccggttaccccgtttaccggttttaaacggtttttcccgggggcccccggtacccgggggtacccccgtaaccggttacccggggttacccgggggacccgttaaaccccggggg

SEQ ID NO: 357141 - DNA, 682 bp, Homo sapiens
  misc_feature: GZ8MTXP02H9RH0.22.36.D03.1.454.CMB.2.raw
  modified_base (217)..(217): a, c, t, g, unknown or other
  misc_feature (217)..(217): n is a, c, g, or t
  modified_base (231)..(231): a, c, t, g, unknown or other
  misc_feature (231)..(231): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttctcactcagggcacagggtcctgggcccagtctgccctgacccagcctgcctccgtgtctggatcatctggacagtcgatcagcatttccngcactgggaccaangtgactagttgggtcttttgactctgtctcctggtaccaacaacacccagacccaacccccatccatcattatgtgtctactcgtcgccctacaggagtctcctctactcgcttctcacgtctccaagtcgtcgacacgacgtccctaccctacgactctacgtcgggccttacgtaggtttcgacggaccgttagttaccttaactttactttacctacggttacgttaacgttttacccgttttaaaagttacggggtaccctaccgttaaccgtttccgtttccggggtttacggggtttttaccggggaccgggtacggtacccgtaaaccgggttaaacgttccgggtaacccggttcccgttaccggttcgaaccggtaacccccggtaaacggtccccttaccggacccccccgtttccgggtaaccttacccgtttcccccgg

SEQ ID NO: 357142 - DNA, 603 bp, Homo sapiens
  misc_feature: GZ8MTXP02HN328.22.36.D03.1.454.CMB.2.raw
  modified_base (218)..(218): a, c, t, g, unknown or other
  misc_feature (218)..(218): n is a, c, g, or t
  modified_base (305)..(305): a, c, t, g, unknown or other
  misc_feature (305)..(305): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggtaccaacaacaccaggacaaaccccccactcatcatttangtgtcactcgtcggccctcagagtctcctcatcgcttctcaggctcaagtctgcaacgacgcctaccctaaccactctcgtcgggctcctagtttgaggactagtcttacttacttacttggtacctaaggtttacccttttaaaaattcggaccgtccctaacttccgttccggttgggttttcggcgggtacggaccgtaccggtaaacgtcggacccgttcccgtaccgggttaccaccggtaaccccgaaagggtccctccggtacccccctcgggtaccctaaccgtttcccg

SEQ ID NO: 357143 - DNA, 633 bp, Homo sapiens
  misc_feature: GZ8MTXP02I6SUR.22.36.D03.1.454.CMB.2.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (255)..(255): a, c, t, g, unknown or other
  misc_feature (255)..(255): n is a, c, g, or t
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacngtgactagttggtctttgactntgtctctgtaccacacaccagccaacccccatcatcattangtntcactcgcgcctnaggatctctcatcgcttctcaggcctccaagtctacggctaaacgccggtccctacccctaacacttccgtcgtcgggtcctacccgtaggttttcggaacgggtaaccgtaggttaccttaaaccgtttaatttaacccgtggtaccttaacgttttacctttaaaaacgttcgggaccctacctactttcgtcggtttcgggttttcgggacggtacggtccgaaaccggtacgtaccggtacccgttccgtaccggtcaacccggtcccgtaaacgggcccttcccggcccccgtttaccggtcctaacgtttccccg

SEQ ID NO: 357144 - DNA, 589 bp, Homo sapiens
  misc_feature: GZ8MTXP02JM7PG.22.36.D03.1.454.CMB.2.raw
  modified_base (305)..(305): a, c, t, g, unknown or other
  misc_feature (305)..(305): n is a, c, g, or t
  modified_base (329)..(329): a, c, t, g, unknown or other
  misc_feature (329)..(329): n is a, c, g, or t
  modified_base (409)..(409): a, c, t, g, unknown or other
  misc_feature (409)..(409): n is a, c, g, or t
  modified_base (418)..(418): a, c, t, g, unknown or other
  misc_feature (418)..(418): n is a, c, g, or t
  modified_base (425)..(425): a, c, t, g, unknown or other
  misc_feature (425)..(425): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggagcttgggtacgaggccggggggtccctgacacgtctcctgtgcagcctctggattcacagtcagcagcaatgccatgagttgggtccncacggctccgaggggaaggggttncgaggtgggtcgtcggggattgggaaagttgagttggtcgccaacgacacgtacgcagacgtcccggtggacgggggccncgttcactnacgttcnccagagacacgttaccgaaaaccacaagtagaaatcctagactaaatgtacagcctacgagccggacgacgacgaccgcgtaccacttcctgtacgacgaaacggtacctccgtttagtttccgggaccgtcgggtacccgacgtcggtcggggaccgccgggg

SEQ ID NO: 357145 - DNA, 568 bp, Homo sapiens
  misc_feature: GZ8MTXP02GQA7I.22.36.D03.1.454.CMB.2.raw
  modified_base (323)..(323): a, c, t, g, unknown or other
  misc_feature (323)..(323): n is a, c, g, or t
  modified_base (372)..(372): a, c, t, g, unknown or other
  misc_feature (372)..(372): n is a, c, g, or t
  modified_base (462)..(462): a, c, t, g, unknown or other
  misc_feature (462)..(462): n is a, c, g, or t
  modified_base (494)..(494): a, c, t, g, unknown or other
  misc_feature (494)..(494): n is a, c, g, or t
  modified_base (511)..(511): a, c, t, g, unknown or other
  misc_feature (511)..(511): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccgggggggtccctgacactctcctgtgcagcctctggattcacagtcagcagcaatgccatgagtgggtccgccaggctccagggaaggggttncagtggggtctcggggattggaaagtgatgggtgccaacacactacggnaacgactccgtgacgggggccattcatcatcaccagagacgacttaccgaaaaacacatagaaatcgtagacaaaattgaacagccctanacgcgccgaggacacggccgtctacttctcgngacgaaaacgtaccctnttaacgttttggggccccgacgggacccgaaccgtacggtcggggaccccaacgggg

SEQ ID NO: 357146 - DNA, 564 bp, Homo sapiens
  misc_feature: GZ8MTXP02GIZSP.22.36.D03.1.454.CMB.2.raw
  modified_base (422)..(422): a, c, t, g, unknown or other
  misc_feature (422)..(422): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggcgttggtacgaggcccgggggggtccctggacactctcctgtgcagcctctggattcacagtcagcagcaatgccatggagttcgggtccgccaggcctccgaggggaaggggttgcaggtgggtcgtcggggagttgggaagtgagtggtcgccacacactacgcagacctcggtgacggggccgctcatcatcncagacgacgactaccgaaaacacagtgaatctacgacaaagtgtacacgcctcacgcgaccgacggaccgaccggtccgtctacttcgtacgtcgacgaaacgtccttacgttacgtttcgggaccgtccggtaccgtaccg

SEQ ID NO: 357147 - DNA, 589 bp, Homo sapiens
  misc_feature: GZ8MTXP02F6W6D.22.36.D03.1.454.CMB.2.raw
  modified_base (305)..(305): a, c, t, g, unknown or other
  misc_feature (305)..(305): n is a, c, g, or t
  modified_base (389)..(389): a, c, t, g, unknown or other
  misc_feature (389)..(389): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtggcggtgaaggtattggagtcgtgggggaggcttggtacgaggccggggggtcctgacactctcctgtgcagcctctggattcacagtcagcagcaatgaccatgagttgggccnccgaggctccgaggggaaggggttgcgaggtgggtcgtcggggattggaagtgacgtggtcgcacacactacgcagactccggnggacgggggcctcttcactcatctaccagacgacgacttaacccgaaaacacaagtgaaatctagactaaatgtaacgagccctacgacgccgaccgacggacgtaccggccgtactaccgttctcgtacgacgtaaacgtaccctgtttacggttttcgggaccgccggtaccgtaccgtacggtcggggacccacggg

SEQ ID NO: 357148 - DNA, 749 bp, Homo sapiens
  misc_feature: GZ8MTXP02HMG3X.22.36.D03.1.454.CMB.2.raw
  modified_base (306)..(306): a, c, t, g, unknown or other
  misc_feature (306)..(306): n is a, c, g, or t
  modified_base (309)..(309): a, c, t, g, unknown or other
  misc_feature (309)..(309): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctagctactgggaccaactagtgactattgggttctttgactctgtctcctgtaccaacaacaccagacccaacccccatcatcattangtntcactcgtcgcctcgaggctctctactactcgtcttctcacgtcctaccaagttcctggacctaacgaccggtcccctaccctaaccacgttcctccggtacgggtccttaccgtacggtttacggaacgggtaacctacggttctttaaactttaactttaccgttacggtaacctttaccggttttaacctttaaaacggttacggggtacccctaccgttaaccgtttccggtttacccgggtttggggtttttacccggggaccggggttaaacggggcccgttaaacccggggtaaacgtttcccgggtaacccccggtttcccggtacccggggttaaccgacccggggttaaaacccccgacgggggtttacccctacccccgggtttcccccccgttaccggggttaaccctttaccccgggttttcccccg

SEQ ID NO: 357149 - DNA, 682 bp, Homo sapiens
  misc_feature: GZ8MTXP02J18XC.22.36.D03.1.454.CMB.2.raw
  modified_base (180)..(180): a, c, t, g, unknown or other
  misc_feature (180)..(180): n is a, c, g, or t
  modified_base (276)..(276): a, c, t, g, unknown or other
  misc_feature (276)..(276): n is a, c, g, or t
  modified_base (376)..(376): a, c, t, g, unknown or other
  misc_feature (376)..(376): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtntcaagtgtgcggtgaagtattggagtcgtgggggaggcttggtacacggcccgggggggtccctgacacctctcctgtgcagcctctggattcacngtcagcagcaatcgccatgtaggttgggccccgtccgaggcctccgaaggggtaggggttgcgaggtggggtcgtcggggatttggaagtcgagtgggtncccaacgacacgtacgcaacgaccgttcccggtaggaccgggggtaccctgtttaccacttaccgtactcctacccgaaggacgaaccgggtaaccttaacccggaaaacacccgtagtacgaaactcccgtaagaccaaagttcggaacacgaccctacgaggaccccgacgggaacggacccgtaccgggtacccgttcctaacgtttccgtacggtacgaacggtaaaccgtcccttacgtttacggttttccgggacccggtccggtacccggactaccgggtaccgggaccgaacccgggg

SEQ ID NO: 357150 - DNA, 727 bp, Homo sapiens
  misc_feature: GZ8MTXP02FQ8RQ.22.36.D03.1.454.CMB.2.raw
  modified_base (191)..(191): a, c, t, g, unknown or other
  misc_feature (191)..(191): n is a, c, g, or t
  modified_base (306)..(306): a, c, t, g, unknown or other
  misc_feature (306)..(306): n is a, c, g, or t
  modified_base (465)..(465): a, c, t, g, unknown or other
  misc_feature (465)..(465): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgnggtgaaggtattggagtcgtgggggaggcttggtacgaggccggggggtccctgacactctcctgtgcagcctcgtggattcacagtcagcagcaatgccatgagttcgggtccncgaggctccgaggggtaaggggttgcgaggtgggtcgtcggggattggaagtgacgtgggtcgaccacgacaccgtacgcgaacgacctccggtgggacggggccctcgttcaagtcaactcgtacccgaagacgtaacgacgttaacccgaaaaaccncgaaacgtagtaaaacttcctaggaacctaaaagttcgtaaaccgacgtaccccgttacgaacgggacccggaccgggaaaccggaacccggaaacccggggtcccccgtttaacgttacccgtttacggttaccggtacggtaaccgggtaaaaccgtaccccgtttcggttttaaacggtttttcccgggggaccccgttacccgggggaccccgttaacccggttaaccggttccggggggaccccgtaaacccggggg

SEQ ID NO: 357151 - DNA, 579 bp, Homo sapiens
  misc_feature: GZ8MTXP02HR5JD.22.36.D03.1.454.CMB.2.raw
  modified_base (465)..(465): a, c, t, g, unknown or other
  misc_feature (465)..(465): n is a, c, g, or t
  modified_base (511)..(511): a, c, t, g, unknown or other
  misc_feature (511)..(511): n is a, c, g, or t
  modified_base (528)..(528): a, c, t, g, unknown or other
  misc_feature (528)..(528): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttggtacaggccgggggggtccctgacactctcctgtgcagccctctggattcacagtcagcagcaatgccatgagtttcgggccgccgaggcctccgaggggaacggggttgcgaggtggggtcgtcggggtattggggaagttgatgggtcgccacaccactacgctagactcccgtgggacgggggtcccacgttcgaatcgaacttctacccgagagaccgacttaccgaaaacncagtagaatctagacaaatcgtacacgcctacagcgccgaggaccncggcccgtctacttcgngtacgacgtaaagccctgtttacgtttcggggacccgtcgggcctaaccgg

SEQ ID NO: 357152 - DNA, 621 bp, Homo sapiens
  misc_feature: GZ8MTXP02GTTGJ.22.36.D03.1.454.CMB.2.raw
  modified_base (311)..(311): a, c, t, g, unknown or other
  misc_feature (311)..(311): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttgggtcttttgactctgtctcctggtaccaacaaccacccacgccaaaccccccactcatcatttatgtntcactcgtcgccctgaggagtctacctcatcgcttctccgcgtcctacgtacgtcgtacgaccacgaccgaccctacccaaccgtctctcgcgtcctcgttagttacggacggacgtacttacttactttacttacgtgtacgttacgttttaaccttaacgtcgtacccgtcttaaccgttcggttcggtttcggggtttccggacggtaaccggtaccgtaacggtaacggtccggttacccgtccggtaccgtcgaaccgaaccgtacgtcccgtcccgtcccccgtacggtccctacgtttccccg

SEQ ID NO: 357153 - DNA, 586 bp, Homo sapiens
  misc_feature: GZ8MTXP02IKN09.22.36.D03.1.454.CMB.2.raw
  modified_base (216)..(216): a, c, t, g, unknown or other
  misc_feature (216)..(216): n is a, c, g, or t
  modified_base (248)..(248): a, c, t, g, unknown or other
  misc_feature (248)..(248): n is a, c, g, or t
  modified_base (585)..(585): a, c, t, g, unknown or other
  misc_feature (585)..(585): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccncttcatcatctcagagacgattaccgaaaacncagtgaatctgacaaatgtacagcctacagccgccggagacacggccgtctacttctgtgcgaaagtcctctagtttttcgggccgtcggccgaccgtacgtcggggccgagggccacccgtcggtccgtaccgtctccgttccacgccctaccaccgaacggcccacgtccgtcccttcccccggcgccctcgctaccgcgacgccaccgtccgacgacgacgaccgacgccggcccgtcggcggtcgtccgtcggttacgaacggtaccttaccgttaccgccgacgttacgtcgttcgtacggcggcggcgtacggacgacggacgctacgagng

SEQ ID NO: 357154 - DNA, 512 bp, Homo sapiens
  misc_feature: GZ8MTXP02H41F7.22.36.D03.1.454.CMB.2.raw
  modified_base (216)..(216): a, c, t, g, unknown or other
  misc_feature (216)..(216): n is a, c, g, or t
  modified_base (247)..(247): a, c, t, g, unknown or other
  misc_feature (247)..(247): n is a, c, g, or t
  modified_base (301)..(301): a, c, t, g, unknown or other
  misc_feature (301)..(301): n is a, c, g, or t
  modified_base (511)..(511): a, c, t, g, unknown or other
  misc_feature (511)..(511): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgaggggccncttcatcatctccagagacgattccgaaaancagtgaatctgcaaatgtacagcctcagcgccgaggacacggccgtctacttcngtgcgaaaagacctctatttttggccgcggccgactactggggccagggcaccctggtcaccgtctcttcagcctcaccaagggcccatcggtcttccccctgccgcccctgctccagacgcacctccgagagcacagccggccctggggctgccctggtcaaggactacttccacgccgtatcgtctgacgcggctggcaaggccgcang

SEQ ID NO: 357155 - DNA, 586 bp, Homo sapiens
  misc_feature: GZ8MTXP02H0GEY.22.36.D03.1.454.CMB.2.raw
  modified_base (234)..(234): a, c, t, g, unknown or other
  misc_feature (234)..(234): n is a, c, g, or t
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (321)..(321): a, c, t, g, unknown or other
  misc_feature (321)..(321): n is a, c, g, or t
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (375)..(375): a, c, t, g, unknown or other
  misc_feature (375)..(375): n is a, c, g, or t
  modified_base (430)..(430): a, c, t, g, unknown or other
  misc_feature (430)..(430): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcacgtgggaaccaanagtgactattgggtctttgactctgtctctagtaccaacaacaccagacccaaacccccatcatctattangtntcactcgtcgccnagactctccncatcgcttcncagctcaagtctgacacgacgtccctacctaacntctctacgggccttaccgtaaggtttcgaacgggaacgtacgttcttaaactttnttacgtacgttacttacgttttacctttaaaagtcgacctacctacttcgttcggtttggtttacggcggtaacggcctaaacggtacgtcggacccgtcctacggtaccgacgcccgtaaggccctccgtacccccgtcgtacctaccgttcccg

SEQ ID NO: 357156 - DNA, 596 bp, Homo sapiens
  misc_feature: GZ8MTXP02FV59F.22.36.D03.1.454.CMB.2.raw
  modified_base (362)..(362): a, c, t, g, unknown or other
  misc_feature (362)..(362): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtatggagtcgtgggggagcgttggtacgaggcccggggggtcctgacactctcctgtgcagcctctggattcacagtcagcagcaatgccatgagttggccgcaggctccgagggagggttgctaggtgggtcgtcggggattgggagtgagtggtcnccacgacactacacgagaccgtccggtggacggggcccgtcttcgatcactcctaccgaagacgtacgtaacttaccgaaaacaccaagtacgaatctagactaaacgtcgtaacacgtccacgacgccgaccgacggaccgaccggtccgtactaccgttcgtacgtacgtaccgtaaacgtacccgttacgtttaacggttttcggggacccggtaccggaccgtaacccgg

SEQ ID NO: 357157 - DNA, 629 bp, Homo sapiens
  misc_feature: GZ8MTXP02IOY8I.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcagcctctggattcacagtcagcagcaatgccatggagttgggtccgcgaggctccggaggggaggggttgcgagggtgggtcgtcggggattggaagtgagtgtcgccacacacgtacgcacgtacctccggtgacgggggccgtcttcatacatcaccagacgaccgaacttaccgaaaactacgacgtagaaacgttctacgaactaaacttaggttaacccgaacgacccgttaccgacgggtcccgaccccggaaccgggaccgacccgggtacccgttacctaccgttccgtggtacgaccgtaaaacgtaccttcgtttagtttcgggcccggtcgcccgtacgtacggcggggaccgacccggg

SEQ ID NO: 357158 - DNA, 550 bp, Homo sapiens
  misc_feature: GZ8MTXP02GYA0P.22.36.D03.1.454.CMB.2.raw
  modified_base (306)..(306): a, c, t, g, unknown or other
  misc_feature (306)..(306): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcgttggtacaggccggggggtccctgacactctcctgtgcagcctctggattcacagtcagcagcaatgccatgagttggccncaggctccgaggggagggttgcgaggtgggtcgtcggggattggggaagtgacgtggtcgccacacactacgcagaccgtccggtggacggggccgcttcgatcatctaccagacgacgactaccgaaaacacagtagatcagacaatgtacacgctacgacgcgcgacgacgaccggccgtacgtacttcgtgtcgacgaaacgtacctacgttacgttttcgggccgtccggaccgtaccgg

SEQ ID NO: 357159 - DNA, 567 bp, Homo sapiens
  misc_feature: GZ8MTXP02IPRP5.22.36.D03.1.454.CMB.2.raw
  modified_base (304)..(304): a, c, t, g, unknown or other
  misc_feature (304)..(304): n is a, c, g, or t
  modified_base (322)..(322): a, c, t, g, unknown or other
  misc_feature (322)..(322): n is a, c, g, or t
  modified_base (381)..(381): a, c, t, g, unknown or other
  misc_feature (381)..(381): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcatgggaccaacagtgactagttgggtctttgactctgtctctggtaccaacaacacccagacccaaaccccccatcatcattangtgtcactcgtcgccctnaggatctctcatcgtcttctcacggctccaagtctgccaacgcgccctaccctacatcncgtggctaccgagtttgaggtacgagtcttacttattactcggtctaggtttacctttaaaagtcggtcctacctactcgttcggtttgggtttccggcggtacggcgtaaccgaggtacgacccgtcgtaccggttacaccggcccgaacggtctcccggccccctgggtacccacgtttccccg

SEQ ID NO: 357160 - DNA, 601 bp, Homo sapiens
  misc_feature: GZ8MTXP02INMUF.22.36.D03.1.454.CMB.2.raw
  modified_base (434)..(434): a, c, t, g, unknown or other
  misc_feature (434)..(434): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcacgtgggaccaacagtgactagttggttctttgactctgtctcctgtaccaacaaccaccacgacccaaaccccccatcactctatttatgtgtcactcgtcgccctcaggatctctcactcgcttctcacgtctcagtctgaccaacgaccgtccctacctacactctcgtcggtctacgtagttagacggtacgtatacttacttacttcncgttacttacgtttactttaaagtcgacctacgtacttcgttcggtttacgggtttcggacggtacggccgtaaacggtacgttaccggtacccgttccgtaccggtaccgaccggtaacccgacggtccctcccggtccccgttaccggtaccctacgtttccccg

SEQ ID NO: 357161 - DNA, 580 bp, Homo sapiens
  misc_feature: GZ8MTXP02HMROA.22.36.D03.1.454.CMB.2.raw
  modified_base (211)..(211): a, c, t, g, unknown or other
  misc_feature (211)..(211): n is a, c, g, or t
  modified_base (219)..(219): a, c, t, g, unknown or other
  misc_feature (219)..(219): n is a, c, g, or t
  modified_base (252)..(252): a, c, t, g, unknown or other
  misc_feature (252)..(252): n is a, c, g, or t
  modified_base (545)..(545): a, c, t, g, unknown or other
  misc_feature (545)..(545): n is a, c, g, or t
  modified_base (579)..(579): a, c, t, g, unknown or other
  misc_feature (579)..(579): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgaggggaaggggttgcaggtgggtctcggggattggaagtgatggtgccacacactacgcagactccgngagggccncttcatcatctccagacgacgattaccgaaaancagtgaatctgacaaatgtacagcctacgagccgccgagacacggccgtctacttctgtgacgaaagtcctgtttagttttcggggccgtcggccgtacgtaccgtggggccacggggccaccccgtgtccgaccgttctccgttcacgtccctaccacccgaacggggcccacgttccggtccctcccccgttggccctcccgtgccctaccgagcgccaccgtccgagacgccacggtcgccggcccgtggctcgcccgtgtacgaagtccttaccgtcaccgtcgttacncgtcgcgacggcggtccgcggacgacgcacgagng

SEQ ID NO: 357162 - DNA, 603 bp, Homo sapiens
  misc_feature: GZ8MTXP02IO61V.22.36.D03.1.454.CMB.2.raw
  modified_base (198)..(198): a, c, t, g, unknown or other
  misc_feature (198)..(198): n is a, c, g, or t
  modified_base (371)..(371): a, c, t, g, unknown or other
  misc_feature (371)..(371): n is a, c, g, or t
  modified_base (441)..(441): a, c, t, g, unknown or other
  misc_feature (441)..(441): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggcttattttaaaaggtgtcaagtgtgnggtgaaggtattggagtcgtgggggaggcttggtacaggccggggggtccctgacactctcctgtgcagcctctggattcacagtcagcagcaatgccatgagttggtccgccaggctaccgaggggtaagggttgcgaggtgggtcgtcggggattgggaagtgagtggtcnccacacactacgcaggactccgtggacggggccgcttcactcatctccaagacgacgactaccgaaaacncaagtacgaaatctagaaccaaatcgtaacacgcctacgacggccgaacccggacggaacccgaccggggtacccttactaaccgtttccgtacggtcggaacgtaaaacgtcccttacgtttacggttttcgggccccggtaccgggtacccgtaacccgg

SEQ ID NO: 357163 - DNA, 646 bp, Homo sapiens
  misc_feature: GZ8MTXP02IOQSX.22.36.D03.1.454.CMB.2.raw
  modified_base (292)..(292): a, c, t, g, unknown or other
  misc_feature (292)..(292): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacagttggtctttgactctgtctctgtaccaacaacacccacgaccaaacccccancactcattangtntcactcgtcgccctcagacgtctctcatcgcttctcaggcctccaaagtctacggaccaaccgaccggtccctacccctaaaccacttcctccgtcgggcccttccgtaggtttagacgggtacgacgttaccttactttacttacctggtactaacgtttaccctttaaaagttcgggacctacctacttcgttcggtttcgggttttccgggacgggtacggtaccgtaaccgggtaaacgttccggttaacccggttccgtaccggtttccgaacggtaaccccgtaaacggtcccgttcccggtaccccccgttcggtcccgtaaccgtttccccgg

SEQ ID NO: 357164 - DNA, 649 bp, Homo sapiens
  misc_feature: GZ8MTXP02F7FSM.22.36.D03.1.454.CMB.2.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcacgtcggaaccaagagtgactagttggttctttgactctgtctctacgtaccaacaaccaccacgaccccaaaccccccactcatactattagtgtctactacgtccgtccgtccctacgaggtactctcctctatcgtcttctcgacgctaccgtaacgtcgtacgaccaacgtacccgtcccctaacccctaaacctcttccgtcgtcggtccttacgtaggtttacggaacggtacgtacgttaccttaactttacgttactacgtacttaacgtttaacctttaaagtcggtcctacctacgttcgttcggttcgggtttcgggacggtacggaccgaacggtacgtccgtaccggttaccgtaccggtaccgaccgaacccggacggtcccgtcccgtcccccgtacggtccctaccgttcccg

SEQ ID NO: 357165 - DNA, 565 bp, Homo sapiens
  misc_feature: GZ8MTXP02FQFOJ.22.36.D03.1.454.CMB.2.raw
  modified_base (218)..(218): a, c, t, g, unknown or other
  misc_feature (218)..(218): n is a, c, g, or t
  modified_base (304)..(304): a, c, t, g, unknown or other
  misc_feature (304)..(304): n is a, c, g, or t
  modified_base (364)..(364): a, c, t, g, unknown or other
  misc_feature (364)..(364): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacattgggtcttttgactctgtctcctggtaccaacaacaccacgacaaaccccccatcactcattangtgtcactcgtcggtcctcagagtctcctcatcgcttctcaggtctcaagtctgctaacncggcctaccctacatctcgtggctccagtttgaggtacgtagtcttaacgttattactgtctagtttacctttaaattacgcgtctacttcgtcgttcggtttcggacggtacggccgtaccggtaacgtacggtacccgtccgttcggcctacggcccgaacggtccgtccggtcccccgtacggtcctaccgtttcccg

SEQ ID NO: 357166 - DNA, 601 bp, Homo sapiens
  misc_feature: GZ8MTXP02IS289.22.36.D03.1.454.CMB.2.raw
  modified_base (401)..(401): a, c, t, g, unknown or other
  misc_feature (401)..(401): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactctcctgtgcagcctctggattcacagtcagcagcaatgccatgagttgggtccgccgaggctccgaggggaaggggttgcgaggtggggtctcggggtattgggaagtgagtgggtgccacacacgtacgcagacctccggtgacggggccncgttcatcatctccgagacgacgacttaaccgaaacacgagtagaatctagacaaagtacgtacacgcctacgacggcgaccgacggaccgacggtcccgtacgttacttcgtcggtacgaacgtaaacggtaccttacgtttacgtttttcgggcccgtaccgggtccgacggtaccggtccgggggaccgacccgggg

SEQ ID NO: 357167 - DNA, 670 bp, Homo sapiens
  misc_feature: GZ8MTXP02JFASM.22.36.D03.1.454.CMB.2.raw
tcagacatacgcgtcacgaccggtgctcgatttagctgcgtcacgatctctcttgggggagagaggagcccagccctgggattttcaggttgttttcatttggtgatcaggactgaacagagagaactcaccatggagtttgggctgaagtggcttttgcttgtggctaattttaaaaggtgtcaagtgtgcggtgaaggtattggagtcgtgggggaggcttggtacgaggcccgggggggtccctggaccactcctcctgtgcagcctctggattcacagtcagcagcaatgccagtgaggttcgggtcccaccgaggcctccgaaggggtaggggttgcgtaggtgggtcgtcggggattgggaagtgagtggtcgccacacactacgcagacctcggtggacggggcctcttcactcagtcctaccgagaacgaaccgtaacgttaacccgaaaaacacgaagtacgaaacgtactacggaactaaaacgtgtaaacctacgacccgtacgaacggccggaccggaacggaccgaaccgggtcccgtacgttaccttccgtaggttacgaaccggtaaaacgtaaccctttcgtttaacggttttccggggacccggtacccgggtcccggtaaccggttaccgggcgggggacccgtaaccgggg

SEQ ID NO: 357168 - DNA, 546 bp, Homo sapiens
  misc_feature: GZ8MTXP02FMT4F.22.36.D03.1.454.CMB.2.raw
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacatttgggtcttttgactctgtctcctggtaccaacaacacccagccaaaccccccactcatcatttatggtgtcactcgtcggccctcagagtctctccatcgcttctcacggctccaagtctggacctaacaccggcctaccctaacctatcctcgtcgggcctcccgtagtttcgaggtacgagtactacttatactgctagttacctttaaagtacgtcgctactcgtcgttggtttcggcggtacggcacgaagtcgaccgtcgtcggtcacgcccgaagctacgccccgtgtccactcttcccg

SEQ ID NO: 357169 - DNA, 540 bp, Homo sapiens
  misc_feature: GZ8MTXP02FH3Y8.22.36.D03.1.454.CMB.2.raw
  modified_base (369)..(369): a, c, t, g, unknown or other
  misc_feature (369)..(369): n is a, c, g, or t
  modified_base (408)..(408): a, c, t, g, unknown or other
  misc_feature (408)..(408): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccgggggggtccctgacactctcctgtgcagcctctggattcacagtcagcagcaatgccatgagttggtccgccaggctccgaggggaaggggttgcaggtggggtctcggggattgggaagtgatgggtgccncacactacgcagactccgtgaggggccgcttcatcatcnccagagacgattaccgaaaacacagtagaatctagacaaatgtacacgcctacgacgcgccgacggacacggccgtctacttcctgtcgacgaaacgacctcgttacgttttcgggccgtcggccgtaaccg

SEQ ID NO: 357170 - DNA, 618 bp, Homo sapiens
  misc_feature: GZ8MTXP02IWB36.22.36.D03.1.454.CMB.2.raw
  modified_base (255)..(255): a, c, t, g, unknown or other
  misc_feature (255)..(255): n is a, c, g, or t
  modified_base (291)..(291): a, c, t, g, unknown or other
  misc_feature (291)..(291): n is a, c, g, or t
  modified_base (324)..(324): a, c, t, g, unknown or other
  misc_feature (324)..(324): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggctattttaaaaggtgtcaagtgtgcggtgaaggtattggagtcgtgggggagcttggtacaggccggggggtccctgacactctcctgngcagcctcgtggattcacagtcagcagcaatgccangagttggccgcgaggctccgaggggtagggttncgaggtgggtctcggggattggaagtgagtggcgccacacacgtacgcgagacctccggtaggaccgggggtcctacgtttacacgttcactcctacgagacgacgtacttacccgaaaacacgagtacgaaatcgtagaactaaatacgtacaacgtccctacgacgccggaaccgcggaaccgacccggtcccgttaccgtacttcggtcgtacgaaccggtaaacgtcccttacgtttacggttttccggcccggtaccggtaccgtacctacggtaccggaccgaccggg

SEQ ID NO: 357171 - DNA, 704 bp, Homo sapiens
  misc_feature: GZ8MTXP02IVM6B.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggagcttggtacgagggcccggggggtccctggactacgtctcctgtgcagcctcgtggattcacagtcagcagcaatcgcctagtggtacggttcgggtcccgccgaggcctacccggagggggtaaggggttgcgtagggttcgggtacggtcggggattagggagtgagttggtcgacccacgaccgaaccgtacggaccacgaaccgttccgggtacgggacgggggccctcgtttacacgttacctaatccgtacccgaacggaacgtaaccgtaaactaaccggaaaaactaccgaaagtacgtaacttaccgtaggtaaacctaaaacgtacgtaaccaacgtacccgttacgaacggcccggaaccggaaccgggaccgtacccgggtacccgttaccttacgttccgtacgtacgtaacgtaaaccgtaccgttacgtttacggttttaccgggcccgtccggtaccgtaaccgg

SEQ ID NO: 357172 - DNA, 594 bp, Homo sapiens
  misc_feature: GZ8MTXP02F7K62.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaggtgtcaagtgtgcggtgaaggtattggagtcgtgggggagcgttggtacgaggccggggggtcctgacactctcctgtgcagcctctggattcacagtcagcagcaatgccatgagttcggtccgccaggctccgaggggagggttgcaggtggtcgtcggggattgggaagtgagtggtcgccataccacgtacgcacgtaccgtccggtggacggggccgtcttacacgtcatcctaccgagacgacgtacgttaccgaaaacacgaagtacgtaatctacgaactaaagtcgtaacacgacctacgaacgccgaaccggacggaccgaccggtacccgtcttaacttcgtacgtcgacgaaacgtaccttacgtttacggtttcggaccggtccggaccgtaacccggg

SEQ ID NO: 357173 - DNA, 594 bp, Homo sapiens
  misc_feature: GZ8MTXP02GPU3J.22.36.D03.1.454.CMB.2.raw
  modified_base (218)..(218): a, c, t, g, unknown or other
  misc_feature (218)..(218): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcacgtgggaccaacagtgactagttggtctttgactctgtctcctgtaccaacaaccaccagacccaaaccccccactcactcatttatggtcgtcactcgtccggtccctcgaggacgtctcctcatcgtcttctcaggcctaccaagtctacgaccaacgaccgccctaccctaacactcctcgtggcctccgtagtttggacggtacgtagttccttaacgttattactgtactacgtttacctttaaatcggcctacctacgttcgttcggttcgggtttcggcggtacggccgaaccgtacggtcgacccgttccgcggtaccaccgtcccgacggtccgtccgcccccgtacggtcctaccctttcccg

SEQ ID NO: 357174 - DNA, 547 bp, Homo sapiens
  misc_feature: GZ8MTXP02F39SA.22.36.D03.1.454.CMB.2.raw
  modified_base (234)..(234): a, c, t, g, unknown or other
  misc_feature (234)..(234): n is a, c, g, or t
  modified_base (255)..(255): a, c, t, g, unknown or other
  misc_feature (255)..(255): n is a, c, g, or t
  modified_base (365)..(365): a, c, t, g, unknown or other
  misc_feature (365)..(365): n is a, c, g, or t
  modified_base (379)..(379): a, c, t, g, unknown or other
  misc_feature (379)..(379): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaccaacngtgactattggtctttgactntgtctctgtaccaacaacacccacgaccaaacccccatcatctatttatggtgcactcgtccggcctcgaggctctcctcatcgtcttctcgagctacagtctgccaacncgccctacctaacnctcctgtcggactcctagtttcgaacggctacgtcttacttattactgtactacgtttactttaaagtcgctaccgtcttcgtggttcggtttcggcggtacgcacggtaatcggaccgtcgtacgcgacggccaacggcctcccgtccccgtcgtaccactttcccg

SEQ ID NO: 357175 - DNA, 611 bp, Homo sapiens
  misc_feature: GZ8MTXP02IOLF6.22.36.D03.1.454.CMB.2.raw
  modified_base (308)..(308): a, c, t, g, unknown or other
  misc_feature (308)..(308): n is a, c, g, or t
  modified_base (371)..(371): a, c, t, g, unknown or other
  misc_feature (371)..(371): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccgggggtccctgacactctcctgtgcagcctctggattcacagtcagcagcaatcgccatggagttcggcccncgaggctccggaggggaggggttgcgaggtgggtcgtcggggattggaagtgagttggcgccncgacacctacgacagacgtccggtggacggggcccgcgttcgactctaatcctaccaggacgaaccgacttaccgaaaacacgagtaagaactcgtacgacaaagttgaacacgcctcaacggccgacccggaacggaccgaccgggtacccgttacgtaacccgttcgtacgttcgaaccgtaaaaccgtaccgttcgtttaacggttttcgggccccggtacggtacccggtaaccgg

SEQ ID NO: 357176 - DNA, 803 bp, Homo sapiens
  misc_feature: GZ8MTXP02HBUEK.22.36.D03.1.454.CMB.2.raw
  modified_base (159)..(159): a, c, t, g, unknown or other
  misc_feature (159)..(159): n is a, c, g, or t
  modified_base (192)..(192): a, c, t, g, unknown or other
  misc_feature (192)..(192): n is a, c, g, or t
  modified_base (214)..(214): a, c, t, g, unknown or other
  misc_feature (214)..(214): n is a, c, g, or t
  modified_base (224)..(224): a, c, t, g, unknown or other
  misc_feature (224)..(224): n is a, c, g, or t
  modified_base (228)..(228): a, c, t, g, unknown or other
  misc_feature (228)..(228): n is a, c, g, or t
  modified_base (257)..(257): a, c, t, g, unknown or other
  misc_feature (257)..(257): n is a, c, g, or t
tcagacatacgcgtcacgaccggtgctcgatttagctgcgtcacgatctctcttggggttttggggggggtccctgacactctcctgtgcagcctctggattcacagtcagcagcaatgccatgagttgggtccgccaggctccgaggggaaggggttncaggtgggtctggggattgggaagtgatgggtnccacacactacgcagactccgnggaggggccncttnatcatctccagagacgattaccgaaaacnctagtagaatctagactaaatcgtacacgacctacgacggaccgaccggacggaccgaccgggtcccgttaccttacctttacgtcggtacggaaccggtaaaacgttacccctttacgttttaaacggtttttccggggaccccggtcccgggtacccggtaaccccgttaccgggtccgggggacccggacgggggtacccctacccccggttacgggtcccgtaccccggttcttcccgttaccgacccggtccccctaccccgaaacccggaaccgggtccccctaacggttcccggttccccttcccccgtcgggccccgtccccgtcgtcccgtaccggacggaccacccgtacccgtaccggaacgaccgacccaaccgggaccggccccgggtccccggtcgggtccccgtacggacccggttacggggtaaccgaaacccgggtaccttaacccgttcccggaaccggttcgttaacgtcggttccggacgggaccgggccggggtacgtacgggacgaacgggtccgacgaacgtg

SEQ ID NO: 357177 - DNA, 591 bp, Homo sapiens
  misc_feature: GZ8MTXP02I8SUH.22.36.D03.1.454.CMB.2.raw
  modified_base (301)..(301): a, c, t, g, unknown or other
  misc_feature (301)..(301): n is a, c, g, or t
  modified_base (394)..(394): a, c, t, g, unknown or other
  misc_feature (394)..(394): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggagcttggtacaggccggggggtccctgacactctcctgtgcagcctctggattcacagtcagcagcaatgccatgagttggcccncgagctcgagggagggttgcgaggtggcgtcggggattggaagtgagtggcgccacacacgtacgcacgtaccgtccggtggacgggggtccncttcgactcactcctaccgaagacgaacgtaccgttaacgaaaaccacgagtacgaactacgtagactaaagtcgtacacgtccctagaacggccgaccgacggacgacccggtccgtcttacgttcgtacgtacgacgaacgtaccttacgttagttttccgggaccgcggtccacgtcggtcgggaccgaccggg

SEQ ID NO: 357178 - DNA, 583 bp, Homo sapiens
  misc_feature: GZ8MTXP02IE3HE.22.36.D03.1.454.CMB.2.raw
  modified_base (221)..(221): a, c, t, g, unknown or other
  misc_feature (221)..(221): n is a, c, g, or t
  modified_base (254)..(254): a, c, t, g, unknown or other
  misc_feature (254)..(254): n is a, c, g, or t
tcagacatacgcgtcacgaccggtgctcgatttagctgcgtcacgatctctcttggggttttgggggggtccctgacactctcctgtgcagcctctggattcacagtcagcagcaatgccatgagttgggtccgccaggctccgaggggaaggggttgcaggtgggtctcggggattggaagtgatggtgccacacactacgcagactccggtgagggccncttcatcatctccagagacgattaccgaaaacncagtgaatctgacaaatgtacagcctcagcgccgaggacgacggccgtctacttctgtcgacgtaaaacgaccttacttagtttttcggggaccgtcggccgaccgtacgtcggggcctacggggctacccgtggtccaccgtctccttccacgccctaccacccgaacgggcccagtcccgtccttcccccgtggcccgccctcgccgtcccgaggacgccacccgtccgacgacgacacgacgccggcccgtgggctcgccgtcggcaaacgtcctacttccgacgtccgtattcgtctgacggcggcgtcggcgaagcgactagag

SEQ ID NO: 357179 - DNA, 581 bp, Homo sapiens
  misc_feature: GZ8MTXP02FZSN8.22.36.D03.1.454.CMB.2.raw
  modified_base (302)..(302): a, c, t, g, unknown or other
  misc_feature (302)..(302): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttgggtacaggccggggggtccctgacactctcctgtgcagcctctggattcacagtcagcagcaatcgccatgagtgggtccnccaggctccgaggggaagggttgcaggtgggtcgtcggggattgggaagtgagtggtcgccacgacactaacgcagactccggtggacggggcccgtcttcatcactctaccagacgacgacttaccgaaaactacagtagaatactagacaaatacgtaacagcctacacgcgaccgaggacacggccgtactacttctcgtcgacgaaacgtacctacgttacgttttaacggggcccgtacggtacccgaccgtacggtcggggccgtaaccgggg

SEQ ID NO: 357180 - DNA, 597 bp, Homo sapiens
  misc_feature: GZ8MTXP02FM3LD.22.36.D03.1.454.CMB.2.raw
  modified_base (304)..(304): a, c, t, g, unknown or other
  misc_feature (304)..(304): n is a, c, g, or t
  modified_base (392)..(392): a, c, t, g, unknown or other
  misc_feature (392)..(392): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctggacactctcctgtgcagcctctggattcacagtcagcagcaatgccatcgagtggtccncaggctcgaggggagggttgcagtgggtcgtcggggatgggaagtgagtggtgccacacactacgcagacctccggtgacgggggccncttacgatcactctaccgagagacgattaccgaaaacacaagtagaactctagacctaaataggtaacacggacctacgacgccgaccggacggaccgtacggcccgtaccgtaccttcgtacgttacgaacggaaacgtaccgtactttaacggtttcgggcccggtccggtaccgaaccgtacggtcggggaccgaaccgggg

SEQ ID NO: 357181 - DNA, 640 bp, Homo sapiens
  misc_feature: GZ8MTXP02FYIXT.22.36.D03.1.454.CMB.2.raw
  modified_base (321)..(321): a, c, t, g, unknown or other
  misc_feature (321)..(321): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggagcttggtacaggccggggggtccctgacactctcctgtgcagcctctggattcacatcagcagcaatgccatgagttggcccgcaggcgtcgagggagggttncgaggtggtcgtgggatggaagtgagtggtcgcacacacgtacgcagtacctccggtggacgggggtccctctttcgacttcgaacgtcctaccgagtaacgaaccgtacgttaacccgaaaaacagaacgtagaaactccgtagtacctaaaagtcggtaacacgtaccctacgacggcccggaacggaaccggaacgacccggggtacccttacttaccgttaccgtacgtcggaaaccgtaaaccgttaccgttcgtttacggtttccgggacccgtccggtacccgtaccgttacggccggggtaccaaccgggg

SEQ ID NO: 357182 - DNA, 626 bp, Homo sapiens
  misc_feature: GZ8MTXP02H5EN0.22.36.D03.1.454.CMB.2.raw
  modified_base (236)..(236): a, c, t, g, unknown or other
  misc_feature (236)..(236): n is a, c, g, or t
  modified_base (312)..(312): a, c, t, g, unknown or other
  misc_feature (312)..(312): n is a, c, g, or t
  modified_base (315)..(315): a, c, t, g, unknown or other
  misc_feature (315)..(315): n is a, c, g, or t
  modified_base (353)..(353): a, c, t, g, unknown or other
  misc_feature (353)..(353): n is a, c, g, or t
  modified_base (399)..(399): a, c, t, g, unknown or other
  misc_feature (399)..(399): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgccctccgtgtctggatcatctggacagtcgatcagctatttcctgcacgtgggaaccaanagtgactagttgggttcttttgactctgtctcctgtaccaacaacacccagcccaaaccccccatcatcatttagngtntcactcgtccgccctgaggtatctctcatcgcttctcncgctccaagtcctacggacctaacgccggcccctaccccgtaaacnctccctcgtcggggacctccgtaggtttcgacggtacgagttctaacgtttattactgtccgttaagtttcctttaaaagtcggtacctcctaccgttcgtttcggttacgggttttcggcgggtacggaccgtaccggtaaaggtcccgaccgttacccgtcgggactaccggaacccgtaacggcccgttccggacccccgtttcgggtacccaccgtttcccgg

SEQ ID NO: 357183 - DNA, 642 bp, Homo sapiens
  misc_feature: GZ8MTXP02I1DC7.22.36.D03.1.454.CMB.2.raw
tcagacatacgcgtcacgaccggtgctcgatttagctgcgtcacgatctctcttgggggagagaggagcccagcccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcttggtacgaggccggggggtcctgacactctcctgtgcagcctctggattcacagtcagcagcaatcgccatgagttcgggccgccgaggctccgaggggaggggttgcgaggtgggtcgtggggattgggaagtgagtggtcgaccacacactacgcacgaccgtccggtaggacggggcctcttcgaactccacgttcctacccgaggaacgtaaccgtacgttaaaccccgaaaacgaccgaagtacgtaaactccgttagaaccgtaaaagtacgtaaccgacgtaccctacgaacggccgaccggaacggaccgacccggcccgttacctacttcgtcgtaccgacgaaaaccgtcccttacgtttacggtttccggcccgtaccggccgacgtacggtcggggacccgtaccggg

SEQ ID NO: 357184 - DNA, 707 bp, Homo sapiens
  misc_feature: GZ8MTXP02JR3S8.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggcgttggtacgagggccggggggtccctgacactctcctgtgcagcctctggattcacagtcagcagcaatcgccagtggaggtttcgggtcccgccgaggcctaccggaaggggtaaggggtttcgcgtagggttgggtcgtcgggggattgggaagtgacgtgggcaccacgacactacgcaacggactccggtaggacgggggccctcgttcactccaactccgtaccgagacgaccgtaacgttaacccgaaaacacgtaggtacaaacgtccgtaagaacctaaaagtacgtaaccgaacgccctacgaacggccggaccggaacggaccgtacccgggtccccgttacgttaccgtttcggtacgtacggaaccggtaaaaccgttacccgttaccggttttaacggttttccggggcccccggttaccgggtaccccgggtaccgttaccggggttaccgggggtacccggtaacccgggg

SEQ ID NO: 357185 - DNA, 523 bp, Homo sapiens
  misc_feature: GZ8MTXP02FQBO6.22.36.D03.1.454.CMB.2.raw
  modified_base (218)..(218): a, c, t, g, unknown or other
  misc_feature (218)..(218): n is a, c, g, or t
  modified_base (304)..(304): a, c, t, g, unknown or other
  misc_feature (304)..(304): n is a, c, g, or t
  modified_base (324)..(324): a, c, t, g, unknown or other
  misc_feature (324)..(324): n is a, c, g, or t
  modified_base (520)..(520): a, c, t, g, unknown or other
  misc_feature (520)..(520): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaacagtgacatgggtctttgactctgtctctggtaccaacaacaccccaggcaaacccccccaatcatcatttanggtgtcactcgtcggccctnaggagtctcctcatcgcttctcaggctccaaagtctgcaacacgcctccctaaaccatctctggctccagtttgaggcagtctacttattaactgtcagtttacctttaaaattacgcgaccactctcgtggttttcgcggtagcaccgaagtcgaccgtcctcggtcagcccgaaggctcgccccctcggtaccnctc

SEQ ID NO: 357186 - DNA, 698 bp, Homo sapiens
  misc_feature: GZ8MTXP02HSDHI.22.36.D03.1.454.CMB.2.raw
  modified_base (220)..(220): a, c, t, g, unknown or other
  misc_feature (220)..(220): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcaagctatttccngcacgtcggaaccaagagtgacttgttggttctttgactctcgtcctaccgtacgtaaccaacaaccacccgaaccgaaccccaaacccccactactactactaagtttagtgtcgtacctaccgttccggtccgtccctacgacggtactcctcctactacgtccgtccttcgtccgacgtcctaccgtaacgttcgtacgaccaaccgtaccgtacccctaaccctaactcgtcgtacgtcggtaccttacgttaggttacggaacggtaccgtacgttacttaactttacgttaccgttacgttaccttaacgttttaaccttaaacgtccgtacctacctacgttcggttcggtttcggggttaccggacggtacggtaccgtaaccggtacgttaccggtacccgttccgtaccggtaccgaaccgaacccgtacgtcccgtcccgtaccccgttcgtaccttaccgttcccg

SEQ ID NO: 357187 - DNA, 635 bp, Homo sapiens
  misc_feature: GZ8MTXP02J3K97.22.36.D03.1.454.CMB.2.raw
  modified_base (210)..(210): a, c, t, g, unknown or other
  misc_feature (210)..(210): n is a, c, g, or t
  modified_base (308)..(308): a, c, t, g, unknown or other
  misc_feature (308)..(308): n is a, c, g, or t
  modified_base (392)..(392): a, c, t, g, unknown or other
  misc_feature (392)..(392): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgngggggaggcttgggtacgaggccggggggtccctggaccacgtctcctgtgcagccttcgtggacttcacagtcagcagcaatgccatgagttggccncgagctcgagggagggtgcagtggtcgtcgggattggaagtgctgggtcacccgactacaccgttacgcagtaccgttccgggngacgggcctactcactctacgtccgtacgacgacgaacgtactaaaccgaaacacgtagtacgtactacgtacgaacgtaacgtacgtaaccgaccgtaccgtaccgaccggacccggaccgggaaccggaccggtacccggtccgttacgttaccgttacgtacgtacgacgtaaccgtaccgtttacgttaccggtttccggcccgtccggaccgtacggtaccggtcgggaccggaccgg

SEQ ID NO: 357188 - DNA, 652 bp, Homo sapiens
  misc_feature: GZ8MTXP02JS8SL.22.36.D03.1.454.CMB.2.raw
  modified_base (304)..(304): a, c, t, g, unknown or other
  misc_feature (304)..(304): n is a, c, g, or t
  modified_base (323)..(323): a, c, t, g, unknown or other
  misc_feature (323)..(323): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggcttgggtacgaggccggggggtccctgacactctcctgtgcagcctctggattcacagtcagcagcaatgccatgagttggccncgaggctcgagggagggtncgaggtggtcgtggggattgggaagttgagtgggtcgaccaacacgacctacgcgaagaccgttcccggagggacgggggccctctttaccgactcctaactcctacccgaggaacgacgtaacgttaccgaaaacacgagtacgaaatcttaggactaaagtacgtaacaacgcctacgaggccgaccggaacggtaccgaaccggtccgtaccgttaccgttcgtacggtacgaaccggtaaacgtacccgttacgttaacggtttttccggggaccccggtaccggtacccgtaacggttacccggtcgggggaccgtacccgggg

SEQ ID NO: 357189 - DNA, 681 bp, Homo sapiens
  misc_feature: GZ8MTXP02HH2EY.22.36.D03.1.454.CMB.2.raw
tcagacatacgcgtcacgaccggtgctcgatttagctgcgtcacgatctctcttggggagctctgagagaggagcccagcccctgggattttcaggtgttttcatttggtgatcaggactgaacagagagaactcaccatggagtttggctgaagtggtcttttgcttgtggcttaattttaaaaggtgtcaagtgtgcggtgaaggtatggagtcgtgggggagcttggtacaggccggggggtcctgacactctcctgtgcagcctcgtggattcacagtcagcagacaatgccagtggtaggttcgggtccccgacgacggtccgtacccggaagggggtaacggggtttgcggtaaggggttcggggtccggtagggggtaagtttggggaaagtggaagttgggtacgaccaccgctaaacgtaccgcaaggtacctcccgggtagggaccggggccctcgtttaccacgttaccacttaccacccgaagaacgaccgtaaacgttaaaccgaaaaacaccgtagtacgtaaacgtcctagaaacctaaagtacgtaacacgtccaccgacgccgaccggacggaccgaccggtaccgtaccgttaaccttcgtcgtacgaaccgaaacgttcccgtaacgtttcgtttaccgggcccgtaccggaccgtaaccgg

SEQ ID NO: 357190 - DNA, 669 bp, Homo sapiens
  misc_feature: GZ8MTXP02GMHQL.22.36.D03.1.454.CMB.2.raw
  modified_base (224)..(224): a, c, t, g, unknown or other
  misc_feature (224)..(224): n is a, c, g, or t
  modified_base (234)..(234): a, c, t, g, unknown or other
  misc_feature (234)..(234): n is a, c, g, or t
  modified_base (252)..(252): a, c, t, g, unknown or other
  misc_feature (252)..(252): n is a, c, g, or t
  modified_base (258)..(258): a, c, t, g, unknown or other
  misc_feature (258)..(258): n is a, c, g, or t
  modified_base (661)..(661): a, c, t, g, unknown or other
  misc_feature (661)..(661): n is a, c, g, or t
  modified_base (668)..(668): a, c, t, g, unknown or other
  misc_feature (668)..(668): n is a, c, g, or t
tcagacatacgcgtcacgaccggtgctcgatttagctgcgtcacgatctctcttggggttttggggggggtccctgacactctcctgtgcagcctctggattcacagtcagcagcaatgccatgagttgggtccgccaggctccgaggggaaggggttgcaggtgggtctcggggattgggaagtgatgggtgccacacactacgcagactcgtgacggggccnttcatcatcncagagacataccgaaacncagtanatctgacaaatgtacacgcctcgacggccgaccggaaggaccgaccgggtcccgtcttaccttcgtggtacgacgaaaacgtccttacgtttacggtttttcggggcccgccgggtacccgtaaccgtacgggtcggggaccgacggggccctacccgttcgggtcctacccgttcttccgttccgaccgcccgtacccaacccgaacgggtcccctaacgtcccggttcccttcccccgtacggccccgtccccgtcgacccgtccgaggaccgacctacccgtaccgacgacgacctaacggcggcccggccgtgggctcgcgtaggtacgaacggtcctaccgtccgacgtacgttactcggtacgtcggacgggtccggacggtcggacgacgggaccncgaaggng

SEQ ID NO: 357191 - DNA, 635 bp, Homo sapiens
  misc_feature: GZ8MTXP02GPY40.22.36.D03.1.454.CMB.2.raw
  modified_base (219)..(219): a, c, t, g, unknown or other
  misc_feature (219)..(219): n is a, c, g, or t
  modified_base (307)..(307): a, c, t, g, unknown or other
  misc_feature (307)..(307): n is a, c, g, or t
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
  modified_base (328)..(328): a, c, t, g, unknown or other
  misc_feature (328)..(328): n is a, c, g, or t
  modified_base (345)..(345): a, c, t, g, unknown or other
  misc_feature (345)..(345): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaacagtgactagttggtctttgactctgtctctggtaaccaacaacacccagacccaaacccccatcatctattangtntcactcgtcgcctnaggntctcctcatcgtcttcncagcctacaagtctgacctaacgccgtccctaccctaacactcctcgtcggccttcccgtaggtttacggacggtacgtacgttaccttaaactttattaccgttgtactaagttttaccctttaaaagttccggaccgtcctacgttcgttcggtttcgggttttccgggacggtacggtccgaaaccggtaaacggttcggtaaccccgttccgttacgggtaccgacgtaaccccggtaacgggcccttaccccggcccccgttcgggtaaccctaccgtttccccg

SEQ ID NO: 357192 - DNA, 712 bp, Homo sapiens
  misc_feature: GZ8MTXP02HKQXU.22.36.D03.1.454.CMB.2.raw
  modified_base (400)..(400): a, c, t, g, unknown or other
  misc_feature (400)..(400): n is a, c, g, or t
  modified_base (451)..(451): a, c, t, g, unknown or other
  misc_feature (451)..(451): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcgttggacgaggccggggggtccctgacgactctcctgtcgcagtcctcgtgacttcacagtcagcagcaagtcgccagtggtagtttcgggtcccgccgaggtcctaccggaagggggaacgggtttgaccgtagggttcggggtccgtacggggtatttagggaaggtggagtcgggtacncccaacgacaccgtacgccgtacgtaccgtccgggtggaccgggggtcccntttacccgaatccgacttcccgaccgaaggtacgacgttacgtaaacccgaaaaccgatagtacgtaaattcgtacgactaaaagtcgtaacgacgtcccagacggccggacgacggtaccgacggtacccgttacgttaccttcggacgttacggaaaccgtaaaccgttacctttaccggttttaacggttttccgggacccggtacccgggtacccgttaaccggtccggggttaccggggtacccggaaacccgggg

SEQ ID NO: 357193 - DNA, 610 bp, Homo sapiens
  misc_feature: GZ8MTXP02HM42L.22.36.D03.1.454.CMB.2.raw
  modified_base (494)..(494): a, c, t, g, unknown or other
  misc_feature (494)..(494): n is a, c, g, or t
  modified_base (548)..(548): a, c, t, g, unknown or other
  misc_feature (548)..(548): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccaggggaaggggttgcaggtgggtctcggggattggaagtgatggtgccacacactacgcagactccgtggagggccgcttcatcatctccagagacgattaccgaaaacacagtagaatctagacaaatgtacacgacctcacgccgcccggaggtaccacgggcccgttacttaccttcgtgtgacgaaaacgtccttcgtttagttttacggggccgcggccgactacgtggggccaggcacccgtgtccaccgtctcttcacgcctcaaccgacggcccacgtccgtcctccccgtgccgtaccctcgccctcgacgggtacacctacccgtccgagacgccaaccgngggcccgcccgtggggcctcggccgtggtaccaacggttactaccggttacccncggtacgttacgtcgtccgtaggacgggccgggtcgacgggaccgaacggccgaacgacgtg

SEQ ID NO: 357194 - DNA, 692 bp, Homo sapiens
  misc_feature: GZ8MTXP02JUVKD.22.36.D03.1.454.CMB.2.raw
  modified_base (305)..(305): a, c, t, g, unknown or other
  misc_feature (305)..(305): n is a, c, g, or t
  modified_base (308)..(308): a, c, t, g, unknown or other
  misc_feature (308)..(308): n is a, c, g, or t
  modified_base (326)..(326): a, c, t, g, unknown or other
  misc_feature (326)..(326): n is a, c, g, or t
  modified_base (372)..(372): a, c, t, g, unknown or other
  misc_feature (372)..(372): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacaggccggggggtccctgacactctcctgtgcagcctctggatcacagtcagcagcaatgccatgagttcggccncgnggctcgaggggagggttncgtagtgggtcgtcggggattgggaagtggagtgggtcgaccctanaccacgtaccgcgagtacccgtaccgggtcggacgggggcccgtcgttcgactaccacttccgtacccgaaggtacgaaccgtaacgttaacccggaaaaaccacgtaaaccggttagaaacttcgtaacggtaaccgtaaaagttacggtaaccaaccgtacccgttaccgaaacgggccgacccggtaacggggaccctaacccggggtcccgttaccgttaaccgtttccgtacgtaccggtaaaccgtaaaaccgtaccccgttacggttttacggttttaccggggacccggtacccgggtacccgtaacccggg

SEQ ID NO: 357195 - DNA, 645 bp, Homo sapiens
  misc_feature: GZ8MTXP02F53I7.22.36.D03.1.454.CMB.2.raw
  modified_base (315)..(315): a, c, t, g, unknown or other
  misc_feature (315)..(315): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggcttaattttaaaaggtgtcaagtgtgcggtgaaggtattggagtcgtgggggaggtcgttggtacgaggcccggggggtcctggacactctcctgtgcagcctctggattcacagtcagcagcaatcgccagtgtaggttcgggtcccnccgaggcctaccggaggggtaggggttcgcgtagggtcgggtcgtcggggtagttgggaagtgagtggtcaccgacacaccgtacgcgacgtaccgtccgggtaggaccggggtcctcttcgaacttcactcccgtaccgaggaacgaaccgtaaccttaacccggaaaaactcgtaaagtagtaaacttcgaagaactaaagtcgtaacacgtcccacgacggccgacggacggaccgacggtcctactactcgtcgtacgaccgtaacgtccttgtttaacgttcgggacccgtcggacccgtaacgtcggtccgggaccgtaccggg

SEQ ID NO: 357196 - DNA, 812 bp, Homo sapiens
  misc_feature: GZ8MTXP02JYH13.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggtcttgggtacggcggggtcccgggggtccacgactactcctcgtgtcgacgcgtcctcgtacgtactaccaacgtcgtacgacgacgacgactaagtccgactaggtaggttacggggtttcccgggtccccgaccgggtacggtcccgtaccggggtaaagggggggttaacggggttcggaccgggtaggggttccggggttaccggggtacgggggttaaggtttaaggggaaggttaggtacgggtcgggtcccgaccaaccgaaccgtaccggtacgaccgtaccggtacccggttccggggacggggaccggggtcccgttacttacgaacgttcctaaaccttcccccgaacgaaaggtaaccggtaaccgtaaaccgtaaaacccgaaaactacgtagtaacgaacttcgaaagaaactaaagtccggtaacaccgtcccagaccggaccggacggtaacgacccgtccgggtccctttactaccgttcggaccggtaacggaaaccgttaaccgtccgtttaccggttttcgggtcccgggacccgttcggaccctacggtccgggggcccgggacgacccgg

SEQ ID NO: 357197 - DNA, 627 bp, Homo sapiens
  misc_feature: GZ8MTXP02GBQ6C.22.36.D03.1.454.CMB.2.raw
  modified_base (220)..(220): a, c, t, g, unknown or other
  misc_feature (220)..(220): n is a, c, g, or t
  modified_base (311)..(311): a, c, t, g, unknown or other
  misc_feature (311)..(311): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagttctgccctgacccagcctgcctccgtgtctggatcatctggacagtcgatcagctatttccngcacgtgggaaccaacagtgactagttgggtcttttgactctgtctctggtaccaacaacacccagaccaaaccccccaatcactcattangtgtcactcgtccggccctcaggactctcctacactcgcttctcaggtcctaccaagtcgtgaccaacaccgtccctaccctaacctatccctcgtaggtcccttacccgtagtttcggaacggtaacgtaacgtctttaaactttacgttacgtcgtactaacgttttaccgtttaaattaccgggcctacctaacgttcgttacggtttacgggtttcggcggtacggctaaccggacgttccgacccgttccgtacggtactaccgaacccgtaacggccttcccgacccccgtcggtaccctactttccccg

SEQ ID NO: 357198 - DNA, 670 bp, Homo sapiens
  misc_feature: GZ8MTXP02F27A2.22.36.D03.1.454.CMB.2.raw
  modified_base (274)..(274): a, c, t, g, unknown or other
  misc_feature (274)..(274): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggagtcgttggtacgacggccggggggtcctgacactctcctgtgcagcctgnggattcacagtcagcagcaatcgaccagtgaggttcggtcccgcgaggctaccggaggggagggttcgcgaggtcgggtacgtcggggattacggaagtggagtggtcgcctacaccgaacgtacgacgtacgaccttcgggtggacggggtcccgtacgtctacgtcacttaccgacccgtagaacggtactaaaccgttaaccggaaaaccacgtaagtaacgtagtacgtaacgactaaacgtcgttaacacgtaccgtacgacggaccgaccggacggaaaccgtcccgggtaccgttacccgttaacgtttcgtacggtaccgtaaccgtaaaacgttccgttacgtttaacggttttccgggaacccggtccgggtacccgttaaccggg

SEQ ID NO: 357199 - DNA, 588 bp, Homo sapiens
  misc_feature: GZ8MTXP02IXX5D.22.36.D03.1.454.CMB.2.raw
  modified_base (218)..(218): a, c, t, g, unknown or other
  misc_feature (218)..(218): n is a, c, g, or t
  modified_base (251)..(251): a, c, t, g, unknown or other
  misc_feature (251)..(251): n is a, c, g, or t
tcagacatacgcgtcacgaccggtgctcgatttagctgcgtcacgatctctcttgggttttggggggtccctgacactctcctgtgcagcctctggattcacagtcagcagcaatgccatgagttgggtccgccaggctccgagggaaggggttgcaggtgggtctcggggattggaagtgatggtgccacacactacgcagactccgtgaggggccncttcatcatctccagagacgattaccgaaaacncagtagaatctagacaaatgtacagcctcagcgccgaggacacggcctctactctgtgacgaaagcctcttagttttcgggccgcggccgaccgtacgtcggggccagggccacccgtggtccaccgtctcttcacgcctaccaccgaacgggcccacgtccggtcctccccctcggcccgccctcgcctccgaggcgccacccgtccgagacgcctacgacggcccggcccgtggggcctcggcccgtggtaccgaaacgggtacctaccgttccgacggtccgtacgtcgtaccgtggacggcgggtccgtacgggaccgaaggccgacgagtag

SEQ ID NO: 357200 - DNA, 650 bp, Homo sapiens
  misc_feature: GZ8MTXP02FKB78.22.36.D03.1.454.CMB.2.raw
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (321)..(321): a, c, t, g, unknown or other
  misc_feature (321)..(321): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctactttccngcacgtgggacccaacngtgactagttggtcttttgactctgtctcgtcggtaaccaacacaccccgacgaccccaaacccccccaatcactctatttagnggtcgtcctactccggtaccggtcccctcgaggtacgtcctccctccagtccgtcctttccgtcgacgggtcctaccgaagttcgtacggaccaaccgaccggtccctaccctaaaccacgttcctcgtcggtccttaccgtaggtttcgaacgggtacgtagttaccttaacttattactcgtacttacgtttacctttaaagtcggccgtcctacgttcttcggttcgggtttcgggcggtacgtaccgaaccgtacggtcgtaccggtccgtcggtccacggtaacccgaaggtccctccggtcccccgtcggtaccacgttcccg

SEQ ID NO: 357201 - DNA, 831 bp, Homo sapiens
  misc_feature: GZ8MTXP02F289R.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggtcttattttaaaaggtgtcaagtgtgcggtgaaggtattggagtcgtgggggagcttggtacgaggccggggggtcctgacactctcctgtgcagcctctggattcacagtcagcagcaaatcgaccagtggtacggtttcggggtccccgaccgtaacggcccgttaccgggaagggggtaaggggtttcgacggtaaggggttcggggttacggttacgggggtagtttaggggaaacggttggtaacggttcggggtcgacccgaaccgaaccgtaacccgttaaccggccgtaacggaacccggttccggggtagggggaaccgggggtcccctcggttactaacttccgaacttcccgttaaccggaaacggtaacgtaaacccggtaaacccttaaacccggaaaaaaacacccgtaaaggttaaggtaaaacttccgtaagtaaaccgttaaacgttacgtaaccgaaccgtacccgtaacgacggcccgggaaccggacgggtaaaccgacccggggtcccttactttaaccgtttccgtagggttaccgaaaccgggtaaaaccgttacccgtttcggttttaaccggttttccggggacccgggtaccggtaccccgttaacggtcccggggtaccggggaccgtaacccggggg

SEQ ID NO: 357202 - DNA, 631 bp, Homo sapiens
  misc_feature: GZ8MTXP02JQ93J.22.36.D03.1.454.CMB.2.raw
  modified_base (475)..(475): a, c, t, g, unknown or other
  misc_feature (475)..(475): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggcttattttaaaaggtgtcaagtgtgcggtgaaggtattggagtcgtgggggaggtcgttgggtacgagggcccgggggggtccctggaccactctcctgtgcagccctctggacttcacagtcagcagcaatcgaccagtgtaggttcggggtccgccgaggccgtccggaagggggtaaggggttgacgtaggtcggggtcgtcggggagttgggaagtgagtggtcgccacacacgtacgcagtaccgtcggtggacgggcctcttcatcactctaccagacgacgtactaaccgaaaacncgtaagtacgaatctagaactaaagtcgtaacacgtcctacgacgcccgaccggtacggaacccgcggtacccgttacttaccgttcgtacggttacgaccgtaaaacgtccttacgtttacggtttccggggcccgtaccgggacccgtaaccgg

SEQ ID NO: 357203 - DNA, 787 bp, Homo sapiens
  misc_feature: GZ8MTXP02HRRQQ.22.36.D03.1.454.CMB.2.raw
  modified_base (217)..(217): a, c, t, g, unknown or other
  misc_feature (217)..(217): n is a, c, g, or t
  modified_base (324)..(324): a, c, t, g, unknown or other
  misc_feature (324)..(324): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcattcccngcactgggaccaacagtgacagtttgggtcttttgacttctgtctcctacggtaccaaacaaccacccgacggacccaaaacccccccatccatactattatcggtntccactcggtccggcccttcgaggtacgtctcctcctactccgtccttcctacgaccggtcctaccgtaacgtcgtacggaccctaaaccgacccgggtccccttaaccccctaaacctactttcccgtcgttacgggggtcccttacccgaacgggtcccgttagggaaagggtacgttcggggaaacggggttccttaggttaaactttttaacttttaaacccggtgtttaccccttaaccttacccgtaaattttacggtaccggtcccggtaaacgggggccccggtaaaccgttaaaacccggttttccgggtttaacggggggtttcggtttccccgggggaaacgggggtaaccggggtaaaccgtaaacggttcccgtaacgggttaacccccggttaccggtaaaccgggttcccgaaccggaccccggtaaacggttccccgttcccccggg

SEQ ID NO: 357204 - DNA, 560 bp, Homo sapiens
  misc_feature: GZ8MTXP02FLV06.22.36.D03.1.454.CMB.2.raw
  modified_base (307)..(307): a, c, t, g, unknown or other
  misc_feature (307)..(307): n is a, c, g, or t
  modified_base (369)..(369): a, c, t, g, unknown or other
  misc_feature (369)..(369): n is a, c, g, or t
  modified_base (440)..(440): a, c, t, g, unknown or other
  misc_feature (440)..(440): n is a, c, g, or t
  modified_base (472)..(472): a, c, t, g, unknown or other
  misc_feature (472)..(472): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggagcttggtacaggccggggggtccctgacactctcctgtgcagcctctggattcacagtcagcagcaatgccatggagttggccncaggctccgaggggacgggttgcaggtgggtctcggggatttgggaagtgagtggtgcccanacactacgcaagtcctccgggtggacggggccgtcgttcatcatctcccagacgtacgacttacgaaaacncaagtagaatcgtagaccaaatgacagtcccncgagccgcgaacggactaccggccgtactaccgttcgtgcgaacgaacgtaccttacgttacgttttcgggccgtacggccgtaaccg

SEQ ID NO: 357205 - DNA, 740 bp, Homo sapiens
  misc_feature: GZ8MTXP02GPLVI.22.36.D03.1.454.CMB.2.raw
  modified_base (274)..(274): a, c, t, g, unknown or other
  misc_feature (274)..(274): n is a, c, g, or t
  modified_base (331)..(331): a, c, t, g, unknown or other
  misc_feature (331)..(331): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggcttggtacaggccggggggtcctgacactctcctgtgcagcctctggattcacngtcagcagcaagtgccatggagtttgggccgcgaggctaccggaggggaaggggttncgtagggtgggtcgtcggggattgggaaagttgacgtggtcgccaacgaccaacgttacgcaacggtacctcccggtaggacggggccgtacgtttccaaatccaactctacccgagaacgtaacgacttaacccgaaaacacgaagtaggtaaaactctacgtaccgtaaaagtaccggttaactaaccggcccttacgaaaccgggcccggaaaccgggtaacggtaaccgggacccggtaacccggttacgttaaacctttcccggtagggttaaaccggaacccgttaaaaaaccgggtcccctttacccgtttttaaagggggtttttcccggggacccccgggcggggttacccccggtaacgtttaaaccccgggggcgggggttaccccgtaacccggggg

SEQ ID NO: 357206 - DNA, 654 bp, Homo sapiens
  misc_feature: GZ8MTXP02I5U7J.22.36.D03.1.454.CMB.2.raw
  modified_base (306)..(306): a, c, t, g, unknown or other
  misc_feature (306)..(306): n is a, c, g, or t
  modified_base (365)..(365): a, c, t, g, unknown or other
  misc_feature (365)..(365): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcgttgggtacgaggcccgggggggtccctggacactctcctgtgcagcctctggattcacagtcagcagcaatgccatgagttggccncgaggctccgaggggaggggttgcgaggtgggtctcggggattggaaagtgagtggtcnccacacactacgcgaagacctccggtagacgggggccctcgttcatcatctaccagacgacgacttaccgaaaacacgagtacgaaatccgtagaacctaaatcgtaacacgccctacgacggcccggaccggaacggaccgaaccgggtccccgttaccgttaccgtttacgtacggtacgtaaccgaaaaccgtacccgtttacgtttaaacggtttttccgggggaccccggttccggggaccccgtaaccgttaccgggtaccgggggtacccgtaacccggggg

SEQ ID NO: 357207 - DNA, 620 bp, Homo sapiens
  misc_feature: GZ8MTXP02F2WAO.22.36.D03.1.454.CMB.2.raw
  modified_base (308)..(308): a, c, t, g, unknown or other
  misc_feature (308)..(308): n is a, c, g, or t
  modified_base (329)..(329): a, c, t, g, unknown or other
  misc_feature (329)..(329): n is a, c, g, or t
  modified_base (465)..(465): a, c, t, g, unknown or other
  misc_feature (465)..(465): n is a, c, g, or t
  modified_base (544)..(544): a, c, t, g, unknown or other
  misc_feature (544)..(544): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggagtcttggtacgacgggcccgggggggtccctggacactctcctgtgcagcctctggattcacagtcagcagcaatgccatgagtggtccncaggctccgaggggagggttncgaggtcgggtcgtcggggattgggaaagtgatgggtcgccaactacgaactacgccgagaccgtccggtggacgggggcctcttcgaatccattccttacagacgaaacgtcttaaaccgaaaaactcaaggtanaaaagttcctagaaacctaaatcgttaaccagacccctagaacgccgaacggtagacgtaccgggccttctaaccgttncggtacgacgaaaacgttcctcgtttaacggtttccggggcccacggacccgtacttacggcggggccaaccgggg

SEQ ID NO: 357208 - DNA, 780 bp, Homo sapiens
  misc_feature: GZ8MTXP02I4XOV.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtggcggtgaaggtattggagtcgtgggggaggtcttgggtacgagggcccggggggttccctgacctacctctcctgtgccagcctcgtggattcacagtcagcagcaatcgccatggtaggttcggggtcccgcgaggcccgtaccggaggggtaaggggtttcgacggtagggttcggggtcggtacggggtatttaggggaaaggtgtaggtggtccggaccacgaaccgtacgtacgcgacgaccgtccggtgggaacgggggcccgtacttcgacttccgacttccgacccgaagaacgtaccgggtaaacttaacccgaaaaacgtacgtaaacggtacgtaaagttccgagtaaaccgtaaaagtacgttaaccgaccgtaccctacggaaccgacccgggttacccgggaaaaccgggaccggtaaaccccgggttccccggtttaccttaaacccgtttccgggttacggttaaccggtaaaacccgggtaaaaccgtttcccccgttttaacggttttaacccggggtttttccgggggacccccggtacccggggttaccccggtttaaacccggg

SEQ ID NO: 357209 - DNA, 635 bp, Homo sapiens
  misc_feature: GZ8MTXP02HI5MA.22.36.D03.1.454.CMB.2.raw
  modified_base (541)..(541): a, c, t, g, unknown or other
  misc_feature (541)..(541): n is a, c, g, or t
  modified_base (573)..(573): a, c, t, g, unknown or other
  misc_feature (573)..(573): n is a, c, g, or t
tcagacatacgcgtcacgaccggtgctcgatttagctgcgtcacgatctctcttgggggagagaggagcccagccctgggatttttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggtattcacagtcagcagcaatgaccagtgacgttgggtcccgcgacggcctccggaaggggtaaggggttgcgagggtggggtcgtcggggatttggaagtgacgtggtacgccaacacaactacgcacggaccttccggaggacgggggccctctttaccgacttccactttcccgacccgaggtaacgaacccgtaacgttaaccccggaaaaaactaccgtaaggtaacgtaaaacttcgttacggaactaaaagttcggaacacgtacccncgacgcgacgacgaccgcgccgttactcgttncgacgacgtaacgtccttcgttacggttccggccgaccgtaccgtacgtcggcgggacgcgg

SEQ ID NO: 357210 - DNA, 695 bp, Homo sapiens
  misc_feature: GZ8MTXP02FONQC.22.36.D03.1.454.CMB.2.raw
  modified_base (218)..(218): a, c, t, g, unknown or other
  misc_feature (218)..(218): n is a, c, g, or t
  modified_base (233)..(233): a, c, t, g, unknown or other
  misc_feature (233)..(233): n is a, c, g, or t
  modified_base (320)..(320): a, c, t, g, unknown or other
  misc_feature (320)..(320): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctatttccngcacgtggaaccaanagtgactgttgggttcttttgactctcgtctccgtggtaccaacaaccacccacggacccaaaccccccaactcatacatttatgtntcactcgtccgccctcgaggtacgtctctcatcgtcttcctcacgggtcctaccgtaagtcgtacggaccaaaccgtacccggcccccttaacccctaaaccctacttcccgtcgttcgggtcccttacccgtaggtttaggaacggtacgtaacgttccttaaactttacttaacgtcgtacttaccgtttaactttaaagttaccggccgtacctactttccggtacggtttcgggttttaccgggccggtaacgggcccgtaaacggtacggtaccggttaccccggtccgtaccggttaccgaaccggtaacccggtaaccggtcccggtaccccggtcccccgtttaccgggtacctacctttcccccgg

SEQ ID NO: 357211 - DNA, 549 bp, Homo sapiens
  misc_feature: GZ8MTXP02G0U0A.22.36.D03.1.454.CMB.2.raw
  modified_base (192)..(192): a, c, t, g, unknown or other
  misc_feature (192)..(192): n is a, c, g, or t
  modified_base (375)..(375): a, c, t, g, unknown or other
  misc_feature (375)..(375): n is a, c, g, or t
  modified_base (383)..(383): a, c, t, g, unknown or other
  misc_feature (383)..(383): n is a, c, g, or t
  modified_base (394)..(394): a, c, t, g, unknown or other
  misc_feature (394)..(394): n is a, c, g, or t
  modified_base (433)..(433): a, c, t, g, unknown or other
  misc_feature (433)..(433): n is a, c, g, or t
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (444)..(444): a, c, t, g, unknown or other
  misc_feature (444)..(444): n is a, c, g, or t
tcagacatacgcgtcacgaccggtgctcgatttagctgcgtcacgatctctcttgggggagagaggagcccagccctgggattttcaggtgttttcatttggtgatcgggactgaacagagagaactcaccatggagtttggcgtgaagtggcgttttgtcttgtggctattttaaaaggtgtcaagtgtgnggtgaaggtattggagtcgtgggggaggcttggtacgagccgggggtcctgacactctcctgtgcagcctctggattcacagtcagcagcaatgccatgagttgggtccgccaggctccgaggggaagggttgcgaggtgggtctcggggattggaagtgactggtgccacacgactacggcngactccgnggacggggccncgttacatcgatctccagagacgatacgaaacacagtanatnananaatnacacgcacgcgcgcgacgacgacgcctctactcgtagcgaacgaaacgtacctacgttacgtttccggccgccggaccggtacgtacggtcggtaccgacggccg

SEQ ID NO: 357212 - DNA, 583 bp, Homo sapiens
  misc_feature: GZ8MTXP02IZW14.22.36.D03.1.454.CMB.2.raw
  modified_base (299)..(299): a, c, t, g, unknown or other
  misc_feature (299)..(299): n is a, c, g, or t
  modified_base (335)..(335): a, c, t, g, unknown or other
  misc_feature (335)..(335): n is a, c, g, or t
  modified_base (359)..(359): a, c, t, g, unknown or other
  misc_feature (359)..(359): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctgtaccaacacaccagccaacccccatcatcattatgtntcactcgtcggccctcaggatctcctcatcgcttcncacggcctccaagtctcgccaacnccggtccctaccctaacctacttccctctcggggcctccgtaggtttgacggtacgtagtccttacttatttactcgtactagtttacctttaaagtacggcgtacctacgttcttcggttcggtttcggcggtacggtcaccggtaacgtcggtacccgttccgtccggtaccacgaacccgtaacggccgtaccggcccccgtcggtaccctacgtttcccg

SEQ ID NO: 357213 - DNA, 652 bp, Homo sapiens
  misc_feature: GZ8MTXP02F919Z.22.36.D03.1.454.CMB.2.raw
  modified_base (302)..(302): a, c, t, g, unknown or other
  misc_feature (302)..(302): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccgggggggtccctgacactctcctgtgcagcctctggattcacagtcagcagcaatgccatgagttgggtccncaggctccgaggggaagggttgcgaggtgggtcgtcggggattgggaaagtggacgtggtcgacctacgacactacggcacggaaccgttccgggttacgggggccctctttacgactctactcctcccgaaggtacgaacgtacttaccgaaaacgacgagtacgaactacgtagaactaaagtagtacacggtacctacgacgccgaccggacggaccgaaccggtccgtacgttacgttccgtaggtacgtaaccggaaacgtacccgttacgtttaacggtttttccggggcccgtccgggtacccggtacgttaacccggttcggggaccgtacggggtaccccg

SEQ ID NO: 357214 - DNA, 612 bp, Homo sapiens
  misc_feature: GZ8MTXP02J2AIN.22.36.D03.1.454.CMB.2.raw
  modified_base (273)..(273): a, c, t, g, unknown or other
  misc_feature (273)..(273): n is a, c, g, or t
  modified_base (307)..(307): a, c, t, g, unknown or other
  misc_feature (307)..(307): n is a, c, g, or t
  modified_base (329)..(329): a, c, t, g, unknown or other
  misc_feature (329)..(329): n is a, c, g, or t
  modified_base (400)..(400): a, c, t, g, unknown or other
  misc_feature (400)..(400): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggtcttggtacgaggccggggggtccctggacactctcctgtgcagcctcnggattcacagtcagcagcatgcatgagttcggcnccaggctccgagggaggtgcgngtgggtcgtcggggattgggaagtggagtcggtcgccacgacacctaacggcaacgtaccgttcccggggngggacggggtcccgtccttacgtactctacgtcctaccgaacgtaacgaacgtaaaccgttaaaccgaaaaccacgaacgtacgtaactacgtacgaactaaacgtacgtaacacgtccacgacgaccgacgacggaccgaccgtccgtactacgtcgtcgtacgacgtaaacgtccgttacgtttacgtttcggccggtacggaccgtacg

SEQ ID NO: 357215 - DNA, 652 bp, Homo sapiens
  misc_feature: GZ8MTXP02F2CCD.22.36.D03.1.454.CMB.2.raw
  modified_base (370)..(370): a, c, t, g, unknown or other
  misc_feature (370)..(370): n is a, c, g, or t
  modified_base (375)..(375): a, c, t, g, unknown or other
  misc_feature (375)..(375): n is a, c, g, or t
  modified_base (407)..(407): a, c, t, g, unknown or other
  misc_feature (407)..(407): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtcctgacactctcctgtgcagcctctggattcacagtcagcagcaatgccagtgagtgggtccgccgaggcctaccgaggggaacggggttgcgaggttgggtcgtcggggtattgggaagtgacgtgggtnaccanacactacgcagacctccggtggacggggcctnttcatctactctaccgagacgacgacttaaccgaaaactacagtagaaactcgtagaactaaagtcgtaacgacgtaccctacgaacggccggacccggaacggaaccgaaccgggtccccgtttaaccgttaccgtttaccgttacggtacggtaaccggtaaaaccgtacccgttacgtttaacggtttttccggggacccgtccggacccggtaccgtacggtaccggggcccgaaccgggg

SEQ ID NO: 357216 - DNA, 586 bp, Homo sapiens
  misc_feature: GZ8MTXP02IEXKU.22.36.D03.1.454.CMB.2.raw
  modified_base (200)..(200): a, c, t, g, unknown or other
  misc_feature (200)..(200): n is a, c, g, or t
  modified_base (224)..(224): a, c, t, g, unknown or other
  misc_feature (224)..(224): n is a, c, g, or t
  modified_base (243)..(243): a, c, t, g, unknown or other
  misc_feature (243)..(243): n is a, c, g, or t
  modified_base (255)..(255): a, c, t, g, unknown or other
  misc_feature (255)..(255): n is a, c, g, or t
  modified_base (260)..(260): a, c, t, g, unknown or other
  misc_feature (260)..(260): n is a, c, g, or t
  modified_base (316)..(316): a, c, t, g, unknown or other
  misc_feature (316)..(316): n is a, c, g, or t
tcagacatacgcgtcacgaccggtgctcgatttagctgcgtcacgatctctcttgggggtggggtctcaggaggcagcgctctcgggacgtctccaccatggcctgggctctgctattcctcaccttcctcactcagggcacagggtcctgggcccagtctcgccctgacccagcctcgcctccgtgtctggatcatcgnggacagtcgatcagtctatttccngcacgtcggaccaagagtnactgtttcggtntttgntctgtctcctagtaccaacaaccaccgacgaccccaacccccatcatctatttagngtctcacgtcgtccgacctgacggtactcctcctcgacttccgtacttctacgacgtcctacctaagtcctaggacccaacgtcgtaccctactaccaaactctctcgtagcttcgtagttcgacgtacgtatactatttactattcgtcttatttacttaacgtgtacctcgtacttcgttggttcggtttcggacggtacgtcgacgtacggtcgtaccgttcgtcgaccgtaacgacccgtacgtcctcccgtccgtcgtcctaccg

SEQ ID NO: 357217 - DNA, 711 bp, Homo sapiens
  misc_feature: GZ8MTXP02F10N6.22.36.D03.1.454.CMB.2.raw
  modified_base (328)..(328): a, c, t, g, unknown or other
  misc_feature (328)..(328): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtggcggtgaaggtattgggagtcggtgggggaggtcgttggtacgacgggtcccggggggtcctggaccactcctcctgtcgcacgcctcgtggtacttcacgagtcagcagacaatcgaccagtgtaggttcgggtccncgaggcctcggaaggggtagggttgcgagggtggtcggtacgggtagtaggaaagtgagttggcaccacactacgtacgcgacgaccgtcgggtagggacggggcctcgttacaacgtcctaactccaacgagaacgtaacgtaaccgttaaacccgaaaactacgaaagtacgtaaataccgtagaaacctaaagttacaacggacacccgacgaacggcccgaacggacggaaccgacccgggtcgttaccttaccgttacgtacggtacgaaacggtaaaccgttacccgttacgttttaacggggtttcccggggaccccggtaccgggtacccccggtaaacggtttaccggggtacccggggccggtaaacccgggg

SEQ ID NO: 357218 - DNA, 576 bp, Homo sapiens
  misc_feature: GZ8MTXP02JCK51.22.36.D03.1.454.CMB.2.raw
  modified_base (301)..(301): a, c, t, g, unknown or other
  misc_feature (301)..(301): n is a, c, g, or t
  modified_base (396)..(396): a, c, t, g, unknown or other
  misc_feature (396)..(396): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcttggtacaggccggggggtccctgacactctcctgtgcagcctctggattcacagtcagcagcaatgccatgagttgggtccnccaggctccgaggggaaggggttgcgaggtgggtctcggggattgggaagtgacgtggtgccacacacctacgcagactccggtgacgggggccncttcatcatctcgagagacgacttaccgaaaacacagtagaatctagacctaaagtcgtaacacgacctcgaacgccgaccggaggaccgacggcccgtactacttcgtcggtgaaaccgaacgtacctcgttacgttttcgggcccgtcggccgtacgtacggtcggggacctacgggg

SEQ ID NO: 357219 - DNA, 582 bp, Homo sapiens
  misc_feature: GZ8MTXP02HEGAL.22.36.D03.1.454.CMB.2.raw
  modified_base (219)..(219): a, c, t, g, unknown or other
  misc_feature (219)..(219): n is a, c, g, or t
  modified_base (355)..(355): a, c, t, g, unknown or other
  misc_feature (355)..(355): n is a, c, g, or t
  modified_base (389)..(389): a, c, t, g, unknown or other
  misc_feature (389)..(389): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcactgggaccaacagtgactagttgggtctttgacttctgtctcctggtacccaacaacacccagacccaaacccccccatcatccatttagtggtataactcgtacgccctgaggtagtctctccatcgcttcncagctccagtctcggacacgacgcctacccaacntctctggcctcgtagttcgagtacgtgtactagttatacgtgtcgtaatttaccgtttaaagttacggccgtcctacttcgtcggtttggtttacggcggacggtaccacggtagtacgtacccgtcgtacgggtaccacgacccgaaggtcccgtaccgtcccccgtaggtcccctacgttcccgttacccg

SEQ ID NO: 357220 - DNA, 661 bp, Homo sapiens
  misc_feature: GZ8MTXP02FFSZU.22.36.D03.1.454.CMB.2.raw
  modified_base (291)..(291): a, c, t, g, unknown or other
  misc_feature (291)..(291): n is a, c, g, or t
  modified_base (299)..(299): a, c, t, g, unknown or other
  misc_feature (299)..(299): n is a, c, g, or t
  modified_base (303)..(303): a, c, t, g, unknown or other
  misc_feature (303)..(303): n is a, c, g, or t
  modified_base (344)..(344): a, c, t, g, unknown or other
  misc_feature (344)..(344): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgactattgggtcttttgactctgtctctgtaccaacacaccagaccaaacccccancatcattnggtntcactcgtcgccctcgaggtacgtctcctcactcgtcttcncgtaggcctaccaagtctacggaccaaacgacccggaccccttacccctaaaccctacttccgtcgtcggggtcccttacccgaggttttacgggaacgggtaccgtacgttaccttaaactttacttaacttcgtacttacgttttaccctttaaaagttaccggtaccgtacctaacgttccgtacggtttcgggtttacggggaccggtacggaccgtaaccggtaacggtaccggtacccggttaccgtccggtaccgaaccggaacccgaaacggtcccgtcccgcccccgttacggtcctaccgtttcccg

SEQ ID NO: 357221 - DNA, 684 bp, Homo sapiens
  misc_feature: GZ8MTXP02I057C.22.36.D03.1.454.CMB.2.raw
  modified_base (267)..(267): a, c, t, g, unknown or other
  misc_feature (267)..(267): n is a, c, g, or t
  modified_base (280)..(280): a, c, t, g, unknown or other
  misc_feature (280)..(280): n is a, c, g, or t
  modified_base (503)..(503): a, c, t, g, unknown or other
  misc_feature (503)..(503): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccgagggaagggttgcagtgggtctcggggattggaagtgatggtgccacacactacgcagactccgtggagggccgcttcatcatcctaccgagacgacgtacttaccgaaaacacagtgaatcngacaaatgtacancctacgagccgaccggaggacgaccggccgtacttacttctgtcgacgtaaacgtccttacgtttacgtttttcggcccgtcggaccgaccccgttaccggtccggggtaccgacgggtccctaccccgttcggtcccgtaccgttccttaccttccgaccgtaccctacccgaacccggaaaccggggcccctaccgttcccgggttccccgttcccccggngggtccccgtcccccgtgtccccgtaccggacggaccgacccgtacccgtaccggacggaccgaccgacgaccggccccggccgtcgggcctcggtcccgttaggaaccgaacggtaccttaccgttaccgcgtcgtagtcgtcgtaggacggtcggtcgtacggacgacggctacgagtg

SEQ ID NO: 357222 - DNA, 625 bp, Homo sapiens
  misc_feature: GZ8MTXP02HTW4D.22.36.D03.1.454.CMB.2.raw
  modified_base (315)..(315): a, c, t, g, unknown or other
  misc_feature (315)..(315): n is a, c, g, or t
  modified_base (332)..(332): a, c, t, g, unknown or other
  misc_feature (332)..(332): n is a, c, g, or t
  modified_base (393)..(393): a, c, t, g, unknown or other
  misc_feature (393)..(393): n is a, c, g, or t
  modified_base (451)..(451): a, c, t, g, unknown or other
  misc_feature (451)..(451): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggcttaattttaaaaggtgtcaagtgtgcggtgaaggtattggagtcgtgggggaggcttgggtacagggcccgggggggtccctggacactctcctggtgcagcctcgtggattcacagtcagcagcaatcgcatgagtggccncaggctcgagggaggtncgagtggctcggggatggaagtgacgtggtcgccacacaactaccgcaacgaccgtccggngggacggggccctcgttcaacgtcattccaccaagacgaaccgtactaaccgaaaacncgaagtagaaacttcgagaactaaaagtacgtaacgaacgccctacgacgaccggacccgtaacggaccgtaacccggggcccttacgttaaccttcgtacgtacgaaccggtaaaacgtcccgtacgttttaacggttttccgggggccccgtaccgggtacccgtaaccggg

SEQ ID NO: 357223 - DNA, 688 bp, Homo sapiens
  misc_feature: GZ8MTXP02IOR6V.22.36.D03.1.454.CMB.2.raw
  modified_base (307)..(307): a, c, t, g, unknown or other
  misc_feature (307)..(307): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctatttttaaaaggtgtcaagtgtgcggtgaaggtattggagtcgtgggggaggcttggtacaggccggggggtccctgacactctcctgtgcagcctctggattcacagtcagcagcaatcgccatgacggttgggtcccncgaggtctccgaggggtaaggggttgcgtagggtgggtcgtcggggtattgggaaagtggagtcgggcacccacgactaccgtacgcgaagccgtccggtggaccgggggccactttcgattcacttccgaccgagaacgacgtaaccttaacccgaaaactaccgtaaggtactaaacttccgtagaaactaaagttacgtaacgacccgtacccgtcaacggcccgacccgggaaggaaacccggaccggttacccggtaccttaccgtttccggtggtaacgaaccggaaaaccgttacccgtttcgttttaaccggtttcggggccccggtaccggtacccggtaacgtacccggtccgggggtaccgaacccgggg

SEQ ID NO: 357224 - DNA, 576 bp, Homo sapiens
  misc_feature: GZ8MTXP02JV4BW.22.36.D03.1.454.CMB.2.raw
  modified_base (314)..(314): a, c, t, g, unknown or other
  misc_feature (314)..(314): n is a, c, g, or t
  modified_base (378)..(378): a, c, t, g, unknown or other
  misc_feature (378)..(378): n is a, c, g, or t
  modified_base (443)..(443): a, c, t, g, unknown or other
  misc_feature (443)..(443): n is a, c, g, or t
  modified_base (454)..(454): a, c, t, g, unknown or other
  misc_feature (454)..(454): n is a, c, g, or t
  modified_base (478)..(478): a, c, t, g, unknown or other
  misc_feature (478)..(478): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagttgggctgaagtggtcttttgcttgtggtcttaattttaaaaggtgtcaagtgtgcggtgaaggtattggagtcgtgggggaggcgttggtacgacgggcccggggggtcctgacactctcctgtgcagcctctggattcacagtcagcagcaatgccatgagttggtccncgaggctaccgaggggaagggttgcaggtgggtcgtcggggattgggaagtgagtggtgcctanacactacgcagactcggtggacggggcctctcgatcagtctccgagacgacgactaccgaaaacncagtaaaacgntctagacaaagtcgtacacgtccncgacgccgacgacggaccgaccggccgtactacgtcgtagtacgacgtaaaacgtccttacgtttacgtttccggggcccgtaccgggaccgtaccgg

SEQ ID NO: 357225 - DNA, 696 bp, Homo sapiens
  misc_feature: GZ8MTXP02I55CH.22.36.D03.1.454.CMB.2.raw
  modified_base (311)..(311): a, c, t, g, unknown or other
  misc_feature (311)..(311): n is a, c, g, or t
  modified_base (373)..(373): a, c, t, g, unknown or other
  misc_feature (373)..(373): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcgttgggtacgaggccgggggggtccctgacactctcctgtgcagcctctggattcacagtcagcagcaatcgccatgaggttcgggtcccnccgaggctccgaggggaggggttgcgaggtgggtcgtcggggattgggaagtgagtgggtcnccaacacacgtacgcagaccgtccggtgggacgggggtccctcttaccgagttcctaactccgtaccgaagaacgtaccgtaacgttaaacccgaaaacaccgagtacgaaatacctagtactaaaagttcgtaaccacgaccctacgaacggccgaccggaacgggaaccgacccgggtacccttacgttaacccgtttcgtacggttaacggtaaaccggtaaaacgtaccccgtttacgtttaaccggttttccgggggccccgttacccggggacccggttaacccgtaccgggttccgggggaacccgtaaccggggg

SEQ ID NO: 357226 - DNA, 635 bp, Homo sapiens
  misc_feature: GZ8MTXP02HZNEP.22.36.D03.1.454.CMB.2.raw
  modified_base (281)..(281): a, c, t, g, unknown or other
  misc_feature (281)..(281): n is a, c, g, or t
  modified_base (389)..(389): a, c, t, g, unknown or other
  misc_feature (389)..(389): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggtcttggtacgaggccggggggtccctgacactctctgttcagtcctctggattcacngtcagcagcaatgccatgaggttcgggcccgccgtaggcctccggaaggggtaaggggttgcgtaggtcggggtccgtaggggtattgggaagtgagtggtgcccacncactaccgcgacgaccgtcggtaggacggggccgtcttacgatcatcctacagacgacgacttaaccgaaaacacgtagtacgaaacttcgaagtacaaatacgtaacgacgacctcgaacgaccgaccggaacggaccgtaacccgggtccgttactaaccgtttcgtacggttacgaaccgtaaaacgtccgttacgtttaacggttttccggggaccgtcccggtaccgtacgttaccggggg

SEQ ID NO: 357227 - DNA, 773 bp, Homo sapiens
  misc_feature: GZ8MTXP02GS8WW.22.36.D03.1.454.CMB.2.raw
  modified_base (306)..(306): a, c, t, g, unknown or other
  misc_feature (306)..(306): n is a, c, g, or t
  modified_base (421)..(421): a, c, t, g, unknown or other
  misc_feature (421)..(421): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaattttaaaaggtgtcaagtgtggcggtgaaggtattggagtcgtgggggaggcttggtacgaggccggggggtcctgacactctcctgtgcagcctctggattcacagtcagcagcaatgccagtgagttcgggccncaggcctccgaaggggagggttgcgtagggtggtcgtcggggattgggaaagtgagtgggtacgccaacgacaccgtacgctaggacccgttccgggtagggaccgggggtcccnctttacgacgttacctaacgttcccgtaccccgaaggtaaccggtaaaccggttaaccgtttaaaaccccggaaaaaacctaaccggtaaaaggttaacgaaaacgtttcccgttaagaaacccttaaaagttaccgttaaaccgaaccgtacccgtaccgaacggacccgggaacccggaacgggaacccgtaacccggggtcccctttaaccgtttaacccgtttccgttacggttaccggaaaccgtaaaacccggtaccctttacggtttaaacgtttttccggggaccccggttaccgggtacccggtaaccgttacccggtaccgggggtacccgtaaccccgggg

SEQ ID NO: 357228 - DNA, 650 bp, Homo sapiens
  misc_feature: GZ8MTXP02JZKMR.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggcccgggggggtccctggacactctcctgtgcagcctctggatcacagtcagcagcaatgccatgtagttcggcccgcgacggctaccggaaggggtaaggggttgacgaggtggggtcgtcggggtattggggaagtggagtggtacgccacgacacgtaccgcaacggtacctccgggtagggacgggggccctcgttacactcgaactccgaccaaggaacgtaacgtaaccttaacccgaaaaacacgtaaggtagaaacttcgtagaactaaatcggtaaccacgtcccgtacgaacgcccggaccgaacggaacccgcccggtaccgtttacctacgtttccgacggttacgacggaaaacggtttccttacgtttacggtttccggcccggtccggaccgttacccgg

SEQ ID NO: 357229 - DNA, 748 bp, Homo sapiens
  misc_feature: GZ8MTXP02G3QUG.22.36.D03.1.454.CMB.2.raw
  modified_base (263)..(263): a, c, t, g, unknown or other
  misc_feature (263)..(263): n is a, c, g, or t
  modified_base (345)..(345): a, c, t, g, unknown or other
  misc_feature (345)..(345): n is a, c, g, or t
  modified_base (510)..(510): a, c, t, g, unknown or other
  misc_feature (510)..(510): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggtcttaattttaaaaggtgtacaagtgtgcggtgaaggtattggagtcgtgggggaggtcttgggtacgaggcccgggggggtcctgacactctctgtncagcctctggattcacagtcagcagcaatcgccagtggacggtttcgggcccgaccaggcctccggaaggggaaggggtttncgtagggtggggtcgtacggggtattaggggaagtgacgtgggtcacccgtacacgaccgtacgccgaacgtaccggtcccggtaggggaccgggggtccctacgtttccaacgtcaacttcccgacccgaaggaccgaacgtaaccgttaaacccggaaaaacnccgtaaacgtagtaaacttccgagtaaacctaaaagttacggtaacccgacggtaccccttaacgaccgggacccgggaaccgaaacggggtaccccgtaaacccgggggtccccttacggtttacctttccggtaagtaccggaccgtaaaaaccgtccccgtttaacgtttacggtttccggggccccgtacccggggaccgttaccgtaccgggtccgggggaccctacccgggg

SEQ ID NO: 357230 - DNA, 617 bp, Homo sapiens
  misc_feature: GZ8MTXP02JIUES.22.36.D03.1.454.CMB.2.raw
  modified_base (222)..(222): a, c, t, g, unknown or other
  misc_feature (222)..(222): n is a, c, g, or t
  modified_base (300)..(300): a, c, t, g, unknown or other
  misc_feature (300)..(300): n is a, c, g, or t
  modified_base (315)..(315): a, c, t, g, unknown or other
  misc_feature (315)..(315): n is a, c, g, or t
  modified_base (357)..(357): a, c, t, g, unknown or other
  misc_feature (357)..(357): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctcgccctgacccagcctgcctccgtgtctggatcatctggacagtcgatccagtctatttccngcacgtcgggaccaagagtgactagttggtctttgactctgtctctagtaccaacaacaccacgacccaaacccccancatctattagtgtcnctactcgtccggcctacgaggtactctcctcactcgtcttcncacgctcaagtcctgaccaacgaccgtccctaccctaacctactcctacgtcggtacctacgtaggttacgaacggtacgtagttacttacttattactacgtacttacgttttaacttaaagtacgtccgtaccttacgtcgttcggttacggtttcggacggtacgtacgaacggtacgtcggtacccgttaccgtacggtaccgaacggtcccgaacgtcccgtcccggtccccttacggtaccctacgtttccccg

SEQ ID NO: 357231 - DNA, 695 bp, Homo sapiens
  misc_feature: GZ8MTXP02IJPN4.22.36.D03.1.454.CMB.2.raw
  modified_base (208)..(208): a, c, t, g, unknown or other
  misc_feature (208)..(208): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtnttggagtcgtgggggaggcttggtacgaggccggggggtccctgacactctcctgtgcagcctctggattcacagtcagcagcaatcgccatggaggttcggtcccgccgaggccgtccggaggggtaaggggttgcgtaggtggggtcgtcggggtattgggaagtgagtggcgaccacacactacggaccacggtaccgtccgggtaggacgggggtccctccgtttacacgtaccaacttcccgtacccgaagaacgaaccgtaacgttaaccccgaaaaacaccgtaaaggtagtaacttcgtacgaactaaagtacgtaacacgccctacgacggaccgaccggaacggaacccgtaccgggtacccggtttaccttaaccgtttcgtacggttaccggtaaaccggtaaaaccgttacccgtttacgttttaccgggtttttccggggaccccggtaccgggtaccccggtttaaaccggg

SEQ ID NO: 357232 - DNA, 594 bp, Homo sapiens
  misc_feature: GZ8MTXP02JZHY2.22.36.D03.1.454.CMB.2.raw
  modified_base (219)..(219): a, c, t, g, unknown or other
  misc_feature (219)..(219): n is a, c, g, or t
  modified_base (251)..(251): a, c, t, g, unknown or other
  misc_feature (251)..(251): n is a, c, g, or t
  modified_base (593)..(593): a, c, t, g, unknown or other
  misc_feature (593)..(593): n is a, c, g, or t
tcagacatacgcgtcacgaccggtgctcgatttagctgcgtcacgatctctcttgggttttgggggggtccctgacactctcctgtgcagcctctggattcacagtcagcagcaatgccatgagttgggtccgccaggctccgagggaaggggttgcaggtgggtctcggggattgggaagtgatggtgccacacactacgcagactcgtgaggggccnttcatcatctccagagacgattaccgaaaacncagtgaatctgacaaatgtacagcctcagcgccgaggacacggccgtctactctgtgacgaaagacctcttattttggggccgcggccgaccgtacgtcggggccaggggccacccgtgggccaccgtcttctcagccctccaccgaacgggcccacgtcccggtccttccccccgtggcccgtcccgtcgccgtcccgaggggacctccgacccgtccggagacgccaccggacgccggcccgtggggcctcgcccgtaggtcgaacgggtacttaccgttcccgaacggtccgtagtcgtcgtggacggtccggggcttacgggacacgggccgacaggng

SEQ ID NO: 357233 - DNA, 672 bp, Homo sapiens
  misc_feature: GZ8MTXP02J1EQF.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttggtacgaggccggggggtcctgacactctcctgtgcagcctctggattcacagtcagcagcaatgccatggtagttcggtccgccaggctccggaggggtacggggttgcgaggtgggtcgtcggggtagttagggagttgaacgtggtcgacccacaccacgtacgcgaacgaccgtccgggtagggacggggtcccgtcgttacaccttacacttcacccgaaggaacgacgtaaccttaaccgaaaaccacgaagtagactacgtacgaactaaagtcggtaaacacgtacctacgacgacccggaccggaacgggtaccgaacccggggcccgttaaccttacgtttcccgtacgggttaaccgtaaccggaaaccgttacccgtttaccggtttaacggtttttacccggggcccggttacccgggacccgttaacccggg

SEQ ID NO: 357234 - DNA, 668 bp, Homo sapiens
  misc_feature: GZ8MTXP02JLLM1.22.36.D03.1.454.CMB.2.raw
  modified_base (304)..(304): a, c, t, g, unknown or other
  misc_feature (304)..(304): n is a, c, g, or t
  modified_base (401)..(401): a, c, t, g, unknown or other
  misc_feature (401)..(401): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaaggtattggagtcgtgggggaggcgttggtacgaggccgggggggtccctgacactctcctgtgcagcctctggattcacagtcagcagcaatgccatgagttggccncaggctcgagggagggtgcgaggtgggtctcggggattgggaagtgagtgggtcgaccacacacgttacgcacgacgtccggtggacgggggccctnttcacgtctactctaccgagaacgacgtaacttaaccgaaaacacgaagtacgtaaatccgtagaactaaacgttacgtaaccgaacgtccctacgacggacccggaccggaacggtaacccgacccgggtacccgttaccgttaaaccgtttcccgtaggttaccgaaacggtaaaaccgtacccgttcgtttaacggtttttccggggccccggtaccgggtacccggtaaccggtacccggtacgggggtacccgtaaccgggg

SEQ ID NO: 357235 - DNA, 555 bp, Homo sapiens
  misc_feature: GZ8MTXP02G45AR.22.36.D03.1.454.CMB.2.raw
  modified_base (362)..(362): a, c, t, g, unknown or other
  misc_feature (362)..(362): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagcctctggattcacagtcagcagcaatgccatggagtggtccgccaggctcgagggaggggttgcgagtgggtcgtcggggattggaagtgatggtcnccacacactaccgcagactccggtggacggggccgcttcatcatctccagacgacgacgttaccgaaaacacagtagaatctacgacaaagtgtacagcctacacgcgaccggacggaccgacggtcccgtactacgttcgtcgtcgacgaaacgtacctacgttacgttttcgggaccggtcggccgtaccg

SEQ ID NO: 357236 - DNA, 586 bp, Homo sapiens
  misc_feature: GZ8MTXP02G0EIM.22.36.D03.1.454.CMB.2.raw
  modified_base (309)..(309): a, c, t, g, unknown or other
  misc_feature (309)..(309): n is a, c, g, or t
  modified_base (331)..(331): a, c, t, g, unknown or other
  misc_feature (331)..(331): n is a, c, g, or t
  modified_base (364)..(364): a, c, t, g, unknown or other
  misc_feature (364)..(364): n is a, c, g, or t
  modified_base (438)..(438): a, c, t, g, unknown or other
  misc_feature (438)..(438): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggtcttttgcttgtggctaattttaaaaggtgtcaagtgtgcggtgaaggtattggagtcgtgggggagcttgggtacaggccggggggtccctgacactctcctgtgcagcctctggattcacagtcagcagcaatcgccatgagttggccnccaggctcgaggggtagggttncaggtggcgtgggattggagtgatggtcgaccngacactacgcaaggactccggtggacggggccgtcttcaactcacttcaccgagagaccgtactaccgaaaacncaagtagaacttcagacctaaagttgaacacgcctacgagccggaccgaacggaccgaaccgggtcccttacgtaaccttcgttacgtacgacgaaacgtacccttcgtttaacgttttcggggacccgtaccgggcccgtaaccggg

SEQ ID NO: 357237 - DNA, 620 bp, Homo sapiens
  misc_feature: GZ8MTXP02F9KHR.22.36.D03.1.454.CMB.2.raw
  modified_base (235)..(235): a, c, t, g, unknown or other
  misc_feature (235)..(235): n is a, c, g, or t
  modified_base (314)..(314): a, c, t, g, unknown or other
  misc_feature (314)..(314): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttcctgcactgggaaccaacngtgactattgggtctttgactctgtctcctggtaccaacaaccacccacgaccaaaccccccactcactctattatgtntcactcgtccggtccctcgagatctcctcactcgcttctcagtcctcaacgtcgtagacctaacgacgtccctaccctaaacctacttcctcgtcgggtcttaccgtaggtttagacggtactacgtcttaacttattacgtagtcgtaacgtttacctttaaaagtacggtactacctacgttcgttcggttcgggtttcggcggacgtaccgtaacggtaacgtcggtaaacccgttccgttaccgggtacaccggaacccgtaacggtccgtccgtacccccgtcggtaccctactttcccgg

SEQ ID NO: 357238 - DNA, 641 bp, Homo sapiens
  misc_feature: GZ8MTXP02FF9E1.22.36.D03.1.454.CMB.2.raw
  modified_base (371)..(371): a, c, t, g, unknown or other
  misc_feature (371)..(371): n is a, c, g, or t
  modified_base (405)..(405): a, c, t, g, unknown or other
  misc_feature (405)..(405): n is a, c, g, or t
  modified_base (444)..(444): a, c, t, g, unknown or other
  misc_feature (444)..(444): n is a, c, g, or t
  modified_base (461)..(461): a, c, t, g, unknown or other
  misc_feature (461)..(461): n is a, c, g, or t
  modified_base (470)..(470): a, c, t, g, unknown or other
  misc_feature (470)..(470): n is a, c, g, or t
  modified_base (479)..(479): a, c, t, g, unknown or other
  misc_feature (479)..(479): n is a, c, g, or t
tcagacatacgcgtcacgaccggtgctcgatttagctgcgtcacgatctctcttgggggagagaggagcccacgccctgggattttcaggttgttttcatttggtgatcaggactgaacagagagaactcaccatggagtttgggctgaagtggcttttgcttgtggcttaattttaaaaggtgtcaagtgtgcggtgaaggtatttggagtcgtgggggaggcgttgggtacaggcccgggggggttcctggaccacgtctcctgtgcagcctctggattcacagtcagctagcaatgcatgagttggtccgcaggctccgaggggaaggggttgcgaggtgggtcgtcggggatggaaagtgacgtggncacgacactacgcagactccggtgacggggtccncttcgaactcaatctaccagagacagttaaccgaaaacncagtacgaaactcgtanactaaagtnttaaaccgngtacccacgacgaccgcccggtaaggaaccgacccggtacccggtacttaaccgttccgtagtacggtaccgaaaacgggtaccccttagtttaaggttttccggggaacccgtcggggtacccgtaaaccgtccggtaaccgggggcccgaaacccggggg

SEQ ID NO: 357239 - DNA, 608 bp, Homo sapiens
  misc_feature: GZ8MTXP02GAH6K.22.36.D03.1.454.CMB.2.raw
  modified_base (317)..(317): a, c, t, g, unknown or other
  misc_feature (317)..(317): n is a, c, g, or t
  modified_base (373)..(373): a, c, t, g, unknown or other
  misc_feature (373)..(373): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttaatttttaaaaggtgtcaagtgtgcggtgaaggtattggagtcgtgggggaggtcgttgggtacgagggcccgggggggtccctgaccacttctcctgtgcagcctctggattcacagtcagcagcaatgccatgagtggccncaggctccgagggagggttgcgaggtgggtcgtggggattgggaagtgagtggtcnccacacactacgcgagacctccgggtggacggggccgcttcgatcatctaccagacgacgacttaccgaaaacacgagtagaatctagacaaagtagtacacgcctacgacgaccgaccgaacggaccgaccggtcccgttacttaaccgttcgtcggttacgaccgtaaaacgtacccgtttacgtttaacggtttttcccggggacccggtaccgggtacccggtaacccggg

SEQ ID NO: 357240 - DNA, 526 bp, Homo sapiens
  misc_feature: GZ8MTXP02IQ667.22.36.D03.1.454.CMB.2.raw
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (290)..(290): a, c, t, g, unknown or other
  misc_feature (290)..(290): n is a, c, g, or t
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
  modified_base (314)..(314): a, c, t, g, unknown or other
  misc_feature (314)..(314): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (333)..(333): a, c, t, g, unknown or other
  misc_feature (333)..(333): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcacgtgggaccaacngtgactagttggtctttgactctgtctctgtaccaacacaccagaccaacccccancatcattangtncactcgcgcctnagntctcncatcgtcttcncagcctacaagtctgacaacgaccgccctaccctaacatctcgtcggcctcgagctgagatgaggctagatttatactgtactactactatagtgacgacggcgactaacgttcgttgggtcgttcgggacggtacggacgtacggcgtaacggtaccgtacgttacggaccgaccgacccgaacggtccccg

SEQ ID NO: 357241 - DNA, 560 bp, Homo sapiens
  misc_feature: GZ8MTXP02HN7VP.22.36.D03.1.454.CMB.2.raw
  modified_base (188)..(188): a, c, t, g, unknown or other
  misc_feature (188)..(188): n is a, c, g, or t
  modified_base (264)..(264): a, c, t, g, unknown or other
  misc_feature (264)..(264): n is a, c, g, or t
  modified_base (301)..(301): a, c, t, g, unknown or other
  misc_feature (301)..(301): n is a, c, g, or t
  modified_base (457)..(457): a, c, t, g, unknown or other
  misc_feature (457)..(457): n is a, c, g, or t
  modified_base (470)..(470): a, c, t, g, unknown or other
  misc_feature (470)..(470): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcacatggagtttgggctgaagtggcttttgcttgtggctattttaaaggtgtcaagtgtgnggtgaaggtattggagtcgtgggggaggcttgggtacaggccgggggggtccctgacactctcctgtgcagccctntggattcacagtcagcagcaatgcatgagttggtccncaggctccgaggggagggttgcgaggtggggtctggggattggggaagtgagtgggtgccacgacacgtacgcagactccggtgacgggggccgcttcatcatctcagagacgtagtaccgaaaacacagtagaatctagacaaatgtacagaccncagcgccgagacncggaccgtctacttctcgtcgacgaacgtaccttacgttacgttttcgggccggtaccggaccgtacgttaccgcgggggccgaccgggg

SEQ ID NO: 357242 - DNA, 631 bp, Homo sapiens
  misc_feature: GZ8MTXP02I6Y2J.22.36.D03.1.454.CMB.2.raw
  modified_base (220)..(220): a, c, t, g, unknown or other
  misc_feature (220)..(220): n is a, c, g, or t
  modified_base (237)..(237): a, c, t, g, unknown or other
  misc_feature (237)..(237): n is a, c, g, or t
  modified_base (239)..(239): a, c, t, g, unknown or other
  misc_feature (239)..(239): n is a, c, g, or t
  modified_base (313)..(313): a, c, t, g, unknown or other
  misc_feature (313)..(313): n is a, c, g, or t
  modified_base (618)..(618): a, c, t, g, unknown or other
  misc_feature (618)..(618): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacgagggtcctgggcccagtctgccctgacccagcctgcctccgtgtctggatcatctggacagtcgatcagctatttccngcacgtgggacccaacngngactagttggttctttgactctgtctctgtaccaacaacaccacgacccaaacccccatcatactattatggtntaactcggtccgccctacgagtacgtctctcactccgtcttctcgacgtcctctaacgtcgtgaccaacgaccggacccttaccctaaacctcgttcctacgtcgggtcctcccgttagttcggacggtaacgtcgttacttactttaacttacgtgtacgttacgtttaacctttaaagtaccgtaccgaccctacgttccgttcgggttcggtttccgggacggtacggaccgtacggtaaacgtccggtaaccgtcccgtcgggtacctccgaccgtaacgcctcccgtccccgtcgtaccncttccgtttcccg

SEQ ID NO: 357243 - DNA, 636 bp, Homo sapiens
  misc_feature: GZ8MTXP02HZ7A9.22.36.D03.1.454.CMB.2.raw
  modified_base (308)..(308): a, c, t, g, unknown or other
  misc_feature (308)..(308): n is a, c, g, or t
  modified_base (474)..(474): a, c, t, g, unknown or other
  misc_feature (474)..(474): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggtcttttgcttgtggctattttaaaaggtgtcaagtgtgcggtgaaggtattggagtcgtgggggaggcgttggtacgagggccggggggtccctgaccactctcctgtgcagcctctggattcacagtcagcagcaatgccatggagttcgggccnccgaggcctaccggaggggtaagggttgcgtaggtggggtcgtcggggtattagggaagtgacgtgggtcgccaacacaccgtacgcgagtacctcccgggtgggaccgggggtcctactttaccgactcaactctaccgagaacgtacgtacttaaccgaaaacngtagtagaaacttcgagactaaaattggaacacgccacgacgccggacgaggaccgacgtcccgtacttacgttccgtagtacgaacgtaaactacccgttacgtttacggtttcgggcccggttacggcccgtaaacgtccggtacgggggacccacgggg

SEQ ID NO: 357244 - DNA, 652 bp, Homo sapiens
  misc_feature: GZ8MTXP02HYMDF.22.36.D03.1.454.CMB.2.raw
  modified_base (304)..(304): a, c, t, g, unknown or other
  misc_feature (304)..(304): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcttgggtacaggccgggggggtccctgacgactctcctgtgcagcctctggattcacagtcagcagcaatgccatgagttgggtccnccgaggctccgaggggaggggttgcgaggtgggtcgtcggggattagggaagtggagtggtgcccgacacacgtacgcgagaccgtccggtgacgggggcccacgtttcactcactctcaagaacgacgtacttaacccgaaaactaccgaagtacgaaacttactaggaactaaaagttcgaaccgacgtacctacgaacggccggacccggaacggggtaaccgacccgggtaccggttcctaaccgtttcgtacggttacggacgtaaaacgtccgttaccgttagtttttccggggccggttaccgggacccgtacgtacccggttcgggggacccgtacgggg

SEQ ID NO: 357245 - DNA, 590 bp, Homo sapiens
  misc_feature: GZ8MTXP02HX4SZ.22.36.D03.1.454.CMB.2.raw
  modified_base (278)..(278): a, c, t, g, unknown or other
  misc_feature (278)..(278): n is a, c, g, or t
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
  modified_base (348)..(348): a, c, t, g, unknown or other
  misc_feature (348)..(348): n is a, c, g, or t
  modified_base (355)..(355): a, c, t, g, unknown or other
  misc_feature (355)..(355): n is a, c, g, or t
  modified_base (388)..(388): a, c, t, g, unknown or other
  misc_feature (388)..(388): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcgttggtacgaggccgggggggtccctgacactctccgtgtgcagcctcgtggtattcacngtcagcagcaatcgcatgagttggccncgaggctcgagggagggtncgaggtggtctggggatggaagtnagtggtnccagacactacgcagactccggtgacggggccncttccatcactctccaagacgacgaactaaccgaaaacaacgagtacgaatcgtagacaaaatgtaacgacgccacacgccggaccggacggacccgaaccggtccgtaccgttaccgttcgtacggtcgaacgtaaacgaccttacgttacgttttcgggcccggacggacccgacgtaccggtcggggaccgaaccgggg

SEQ ID NO: 357246 - DNA, 614 bp, Homo sapiens
  misc_feature: GZ8MTXP02FI8I5.22.36.D03.1.454.CMB.2.raw
  modified_base (307)..(307): a, c, t, g, unknown or other
  misc_feature (307)..(307): n is a, c, g, or t
  modified_base (439)..(439): a, c, t, g, unknown or other
  misc_feature (439)..(439): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacgaggcccgggggggtccctggacactctcctgtgcagcctctggattcacagtcagcagcaatgccatgagttgggtccncgaggctccgaggggaaggggttcgcgaggtgggtcgtcggggattggaagtgagtggtcgccacacactacgcagacctcggtggacggggccgcttcgactcatcctcagaacgacgattaccgaaaacncagtagaaatcagactaaatcgtaacacgcctacgacgccggaccgagggacccacgggtacccttacgtaccttacgtcgtacgaaccgtaaacgtacccgttacgtttaacggttttcgggacccggtaccggaccccggtacgttaaccgggtcggggacccgtaaccgggg

SEQ ID NO: 357247 - DNA, 593 bp, Homo sapiens
  misc_feature: GZ8MTXP02H5EPV.22.36.D03.1.454.CMB.2.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
  modified_base (302)..(302): a, c, t, g, unknown or other
  misc_feature (302)..(302): n is a, c, g, or t
  modified_base (305)..(305): a, c, t, g, unknown or other
  misc_feature (305)..(305): n is a, c, g, or t
  modified_base (320)..(320): a, c, t, g, unknown or other
  misc_feature (320)..(320): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcactgggaccaangtgactattgggtctttgactctgtctctggtaccaacaaccaccagccaaaccccccatcatcatttangtntcactcgtcgccctnagatctcctcatcgcttctcacggctaccaagtcgtgaccaacgaccggcctacccctaacacttcctctcgggccctccgtaggttttcgaaggacgtacgtcttaactttacttaacgtcgtacttaacgtttaccgtttaaaattcgggcctaccctaacttcgttccggtttgggttttccggcggttaacggcctaccggtaacgtcggaacccgtccgtaccggtcacgccctaaggccttccggccccctcggtaccactttcccg

SEQ ID NO: 357248 - DNA, 591 bp, Homo sapiens
  misc_feature: GZ8MTXP02FJ93X.22.36.D03.1.454.CMB.2.raw
  modified_base (331)..(331): a, c, t, g, unknown or other
  misc_feature (331)..(331): n is a, c, g, or t
  modified_base (401)..(401): a, c, t, g, unknown or other
  misc_feature (401)..(401): n is a, c, g, or t
  modified_base (437)..(437): a, c, t, g, unknown or other
  misc_feature (437)..(437): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccgggggggtccctgacactctcctgtgcagcctctggattcacagtcagcagcaatgccatgagtttgggtccgccgaggctccgaggggtaaggggttgngaggtggggtcgtcggggattggaagtgagtggtgccacgacacgtacgcagactccgtgacgggggccncgttcattcatctaccagagacgattaccgaaaacncagtagaaatctggaacaagttcgtaacgagtcccagacgccgacccggtaggaccgacggcccgtacttccttacgtgtacggacaaaacgtccctcgtttaacgttttcggggcccgtacggcccgaacgttaccggcgggggaccaccggg

SEQ ID NO: 357249 - DNA, 573 bp, Homo sapiens
  misc_feature: GZ8MTXP02FIMYC.22.36.D03.1.454.CMB.2.raw
  modified_base (221)..(221): a, c, t, g, unknown or other
  misc_feature (221)..(221): n is a, c, g, or t
  modified_base (251)..(251): a, c, t, g, unknown or other
  misc_feature (251)..(251): n is a, c, g, or t
  modified_base (321)..(321): a, c, t, g, unknown or other
  misc_feature (321)..(321): n is a, c, g, or t
  modified_base (426)..(426): a, c, t, g, unknown or other
  misc_feature (426)..(426): n is a, c, g, or t
  modified_base (443)..(443): a, c, t, g, unknown or other
  misc_feature (443)..(443): n is a, c, g, or t
tcagacatacgcgtcacgaccggtgctcgatttagctgcgtcacgatctctcttgggttttggggggggtccctgacactctcctgtgcagcctctggattcacagtcagcagcaatgccatgagttgggtccgccaggctccagggaaggggttgcagtgggtctcggggattggaagtgatggtgccacacactacgcagactccgtgagggccgcttnatcatctccagagacgattacccgaaaacncagtgaatctgacaaaatgtacagcctcagcgccgaggacacggccgtctactctgtgacgaaaagcctnttagttttgggccgcggccgacctacgtggggccagggcacccgtggtccaccgtctcttacgcgcctccaccacgggcccactcggtccttcccccgtggcccnccctgcctccgaggacnccaccctccgacgcgccacgacgcccgggccctgggccgtcgcccgtgggtaccgaaaggtacctaccgtttaccgaaccgcgttaacgttcgtacgtggacggcggtccggcggacgacggcgacagag

SEQ ID NO: 357250 - DNA, 584 bp, Homo sapiens
  misc_feature: GZ8MTXP02HBC1U.22.36.D03.1.454.CMB.2.raw
  modified_base (307)..(307): a, c, t, g, unknown or other
  misc_feature (307)..(307): n is a, c, g, or t
  modified_base (327)..(327): a, c, t, g, unknown or other
  misc_feature (327)..(327): n is a, c, g, or t
  modified_base (360)..(360): a, c, t, g, unknown or other
  misc_feature (360)..(360): n is a, c, g, or t
  modified_base (374)..(374): a, c, t, g, unknown or other
  misc_feature (374)..(374): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccggggggtccctggacactctcctgtgcagcctctggattcacagtcagcagcaatgccatgagtggccncaggcctcgagggagggttncaggtggtctggggattggagtgatggtgccanacactacgcagacncggtggacggggccgtcttcgatcacgtctccacggacgacggtacttaacccggaaaaacaccgtaagtacgtaaactcctaggaacaaagtcgtaacacgacctcgacgcgacccggaggaccgacggcccgtactacgttccgtagtcgacgtaaacgtacccttacgtttacggttttccgggcccggtaccggaccgtaacccgg

SEQ ID NO: 357251 - DNA, 618 bp, Homo sapiens
  misc_feature: GZ8MTXP02JVQHA.22.36.D03.1.454.CMB.2.raw
  modified_base (308)..(308): a, c, t, g, unknown or other
  misc_feature (308)..(308): n is a, c, g, or t
  modified_base (407)..(407): a, c, t, g, unknown or other
  misc_feature (407)..(407): n is a, c, g, or t
  modified_base (458)..(458): a, c, t, g, unknown or other
  misc_feature (458)..(458): n is a, c, g, or t
  modified_base (551)..(551): a, c, t, g, unknown or other
  misc_feature (551)..(551): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagttgggctgaagtggcttttgcttgtggcttaagttttaaaaggtgtcaagtgtgcggtgaaggtattggagtcgtgggggagcttggtacgaggccggggggtcctgacactctcctgtgcagcctctggatcacagtcagcagcaatgccatggagttcggccncgaggctaccgaggggtaacggggttgcgaggtggggtcgtcggggtagttagggaagtggagtggtacgccgacacgactaccgacgagaccgtcggngggacggggcctacttcgatcatcaccagacgacgtactaacccgaaaacnctaggagtaactcgtacgacaaagtggttaacacgtcctacgacgaccggaacccggacggacccgtacggacccgtacttaaccgtttccgnggtaccgaacgtaaacgtcccgttaacgtttcggtttaccgggcccggtccggtacccggtaaccgg

SEQ ID NO: 357252 - DNA, 578 bp, Homo sapiens
  misc_feature: GZ8MTXP02IWYD5.22.36.D03.1.454.CMB.2.raw
  modified_base (304)..(304): a, c, t, g, unknown or other
  misc_feature (304)..(304): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttgggtacaggccgggggggtccctggacactctcctgtgcagcctctggattcacagtcagcagcaatgccatgagtgggtccnccaggctccgaggggaggggttgcgaggtggggtctcggggattgggaagtggagtgggtgccacgacactacgcacgacctccgggtgacgggggccgacttcatcatcctcgagagacgacttaccgaaactacagtgaaatctagactaaatcgtacacgccctacgagcgaccggagtaccgacgcccgtactacgttctggtcgacgaaacgtaccttcgttacgttttcgggacccgtcggaccgtacgtacgtcggggacgaccggg

SEQ ID NO: 357253 - DNA, 730 bp, Homo sapiens
  misc_feature: GZ8MTXP02IJVAB.22.36.D03.1.454.CMB.2.raw
  modified_base (345)..(345): a, c, t, g, unknown or other
  misc_feature (345)..(345): n is a, c, g, or t
tcagacatacgcgtcacgaccggtgctcgatttagctgcgtcacgatctctcttggggagctctgagagaggagcccagccctgggattttcaggttgttttcatttggtgatcaggactgaacagagagaactcaccatggtagtttggctgaagtggtcttttgctttgtggtacttaagtttttaaaaggtgtacaagtgtggcggtagaaggtattggagtcggtgggggagtcgttggtacgacgggccgggggtccctgactacttctcctgtcgcagtcctcgtggacttcactagtcagcagacaatcgaccagtcggtaggtttcggccccgacgnggtaccgtaccgggtaaggggtaacggggtttcgcggtaaggggtcggggtaccggttacgggggtaagtttaggggaagttggtacgttcgggtaccgacccacgaccgtaaccgtaccggccgacggtaccggttccgggtacggggaccggggtccctacctttacgacttcaacgttccgtaccgaagaaccgtaaccgtaaactaccgaaaactcgtaagtacgtaaacttccgtagaaactaacgtacgtaaaccgtcgtaccacggacgacccggacggaaacggaccgtacccggtacttacgtacgttcgaacgttcgaaaccgttaacgtaccgtttacggtttacggtttccggccgtaccggtacgtaaccgg

SEQ ID NO: 357254 - DNA, 568 bp, Homo sapiens
  misc_feature: GZ8MTXP02FVEC2.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtctgggggaggcgttggtacgaggccgggggggtccctgacactctcctgttcagcctctggattcacagtcagcagcaatgccatgagtggtccgcaggctccgagggaggggtgcgagtggggtgtcggggattcggagtgagtggtgccacacactacgcacgactccgtggacggggccgtcgttcgatacgactcctaccacgtagaacgacgttaccgaaactaacagtagaatactgacaaatgacacgctcacgcgcgacggacacggccgtcgtaccttcgtacgtcgacgaaacgtaaccgttacgttacgttttacggccggtaccggtaccgtaccgtaccggg

SEQ ID NO: 357255 - DNA, 618 bp, Homo sapiens
  misc_feature: GZ8MTXP02HRDBS.22.36.D03.1.454.CMB.2.raw
  modified_base (279)..(279): a, c, t, g, unknown or other
  misc_feature (279)..(279): n is a, c, g, or t
  modified_base (398)..(398): a, c, t, g, unknown or other
  misc_feature (398)..(398): n is a, c, g, or t
  modified_base (429)..(429): a, c, t, g, unknown or other
  misc_feature (429)..(429): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttaagttttaaaaggtgtacaagtgtggcggtgaaggtatggagtcgtggggagcttggtacgaggccggggggtcctggacacgtctccgtgtgcagcctgtggacttcacngtcagcagcaaatcgaccaagtcgtaggtttcgggcccgaccgtaggcctaccggaaggggtaagggttgcgtagggtcgggtccgtggggtattagggaaagtgaccgtggcgaccanactacgagccagactccggagacggggcctnttacatcatcaccagacgacgtactaaccgaaacacgatagaatcagaacaatgacacgcacgacggcgacggacgtaccgaacggcccgttactacgttcgtacgacgaacggtaaactacccgttaagttacggtttcggcccggtaccggtacccgtacgtaaccggtccggggaccaacccgggg

SEQ ID NO: 357256 - DNA, 646 bp, Homo sapiens
  misc_feature: GZ8MTXP02JH5UO.22.36.D03.1.454.CMB.2.raw
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattggtctttgactctgtctctgtaccaacacacccagacccaaacccccatcatcattangtntcactcgtccgcctcaggacgtctcctcatcgcttctcgtagcctaccaagtccgtaggaccaaccgaccggccctaccccctaaacctacttccgtcgtcgggcccttacgtacggtttcggacgggtaacgtacgttacttaacctttacttaccgtcgtacttaacggtttaccctttaaaagttccggaccgtaccctaacgttcttcggtttcggtttacgggccggtaacggcctaaccgggtacggttaccgaacccggttcccgtccgggtccaccggtaaccccgaaacggtcccgtaccggtccccccgtaccggtacccgtaccctttccccg

SEQ ID NO: 357257 - DNA, 647 bp, Homo sapiens
  misc_feature: GZ8MTXP02FL8MM.22.36.D03.1.454.CMB.2.raw
  modified_base (488)..(488): a, c, t, g, unknown or other
  misc_feature (488)..(488): n is a, c, g, or t
tcagacatacgcgtcacgaccggtgctcgatttagctgcgtcacgatctctcttggggagctctgagagaggagcccagcccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtggggagcttggtacaggccgggggtcctgacactctcctgttcagcctctggattcacagtcagcagcaatcgaccagtgaggttcggtcccgccgaggcctccggaaggggtaacggggttgacgtaggttcggggtcgtcggggtattcgggaagtgagtggtcgaccacacacgtacgcgacgaccgtccggtggacgggggcccgtcttacactctactccgtacccgaggaacgaaccgtacttaaacccgaaaacacgtagtaanaaacgtcgtaggaacctaaaagttcgtaacgacgtcccgtacgacggacccgaccggaacggacccgtaacgggtcccgttacttaccgttcgtacgtacgacgtaaaacgtcccgttacgtttacgtttccgggcccgtacggaccgtacgtaccggg

SEQ ID NO: 357258 - DNA, 599 bp, Homo sapiens
  misc_feature: GZ8MTXP02GDFYU.22.36.D03.1.454.CMB.2.raw
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttaattttaaaaggtgtcaagtgtgcggtgaaggtattggagtcgtgggggaggcttggtacgaggcccggggggtcctgacactctcctgtgcagcctcgtggattcacagtcagcagcaatgccatggaggttcggggcccgccgagggccttccggaaggggtaacggggttgcgtaggtgggtcgtcggggattgggaagtgagtggtcgaccacacgactacgaccacgtaccgtccggtgggacggggccgtcgtcactcatctccagacgacgtactacgaaaacacagtagtaatcgtagacaaagtacgtacacgtcacgacgccgaccggacggaccgacggtccgtacttacgttcgtcgtacgacgaaacgtaccttacgttacggtttcgggccggtaccggtaccgtaaccgg

SEQ ID NO: 357259 - DNA, 566 bp, Homo sapiens
  misc_feature: GZ8MTXP02FR75O.22.36.D03.1.454.CMB.2.raw
  modified_base (325)..(325): a, c, t, g, unknown or other
  misc_feature (325)..(325): n is a, c, g, or t
  modified_base (356)..(356): a, c, t, g, unknown or other
  misc_feature (356)..(356): n is a, c, g, or t
  modified_base (360)..(360): a, c, t, g, unknown or other
  misc_feature (360)..(360): n is a, c, g, or t
  modified_base (378)..(378): a, c, t, g, unknown or other
  misc_feature (378)..(378): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggagcttgggtacgaggccggggggtccctgacactctcctgttcagcctctggattcacagtcagcagcaatgccatgagtggccgcaggctcgagggagggtncgagtggtctcggggattggaagtgatggtnccancactacgcaagcctcggnggacgggccgcttcgatcatcctacagacgacgtactaaccgaaaactacaagtagaatctagaaccaaatcgtaacgacgccctacgacgaccggaccggaacggaccgaccggccgttactacttcgtcgtacgacgtaaacggtccttacgttacgttttcgggccgtcggccgtacgtaccggg

SEQ ID NO: 357260 - DNA, 634 bp, Homo sapiens
  misc_feature: GZ8MTXP02GK8JG.22.36.D03.1.454.CMB.2.raw
  modified_base (219)..(219): a, c, t, g, unknown or other
  misc_feature (219)..(219): n is a, c, g, or t
  modified_base (301)..(301): a, c, t, g, unknown or other
  misc_feature (301)..(301): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcactgggaccaacagtgactgttggttctttgactctgtctcctggtaacccaacaaccacccacgacccaaaccccccancatctattatgtctcactcgtcgccctgagatctcctcatcgtcttctccgaggtcctacctaagttcgtacgacccaaaccgcccgtaccctaccctaaacctactccgtcgtcgggccttaccgtagtttacggacggtacgtacgttacttaactttacttactcgttactacgtttacttaaagtcgaccgtacctacttcgttcggttacggtttcgggacggtacggtaccgtaacggtacggttaccgtacccgttccgttccggaccaccggtaacccgaacggtcccgtaccggtccccccgttcggtccctacggtttccccg

SEQ ID NO: 357261 - DNA, 732 bp, Homo sapiens
  misc_feature: GZ8MTXP02HKUYL.22.36.D03.1.454.CMB.2.raw
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (302)..(302): a, c, t, g, unknown or other
  misc_feature (302)..(302): n is a, c, g, or t
  modified_base (306)..(306): a, c, t, g, unknown or other
  misc_feature (306)..(306): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctaattttaaaaggtgtcaagtgtgcggtgaagtatggagtcgtgggggaggcttggtacaggccggggggtccctgacactctcctgtgcngcctntggnttcacagtcagcagcaatcgccatgagttcggtccnccgnggctccgaggggagggttgcgtaggtcgggtcgtcggggattggggaagtcggagtcggtcgacccacgacactacgccaggtacctccggtggacggggccctcttacgactccgactcctaccgaggacgtacgaacgttaaacccgaaaacgtacgtaaagtacgtaaaactccgttaaagaacccgttaaaagtcggtaaaccgacgtacccccgtaacgaccgggacccggtaccgggaaacgggttaccccggaacccgggtcccggtttaacccgtttaccgtttccggttacggacgggtaaacccggtaaaaccggttacccgttaccggtttttaacggttttcccgggggacccggtaccggggttacccccgaaaacggtttcccgggtaccgggggacccttaaccccggggg

SEQ ID NO: 357262 - DNA, 643 bp, Homo sapiens
  misc_feature: GZ8MTXP02FMB12.22.36.D03.1.454.CMB.2.raw
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacaggccggggggtccctgacactctcctgtgcagccctctggattcacagtcagcagcaatgccatgagttgggtccgcaggctaccgagggaaggggttgacgaggtggggtcgtcggggattgggaaacgtgacgtgggtgaccacgacactaacgcagactccggtaggacgggggccctcttcgatcgactcctaccgagacgacgacttaaccgaaaacctacgagtacgtaaatcgtacgactaaagtcgtacacgtccaccgacggccgaccggaacggaccgaaccgggtccgttaacctacgtttcgtacggtacgaacggtaaaacgtacccgttacgtttaacggtttttcggggcccggtaccgggtacccggtaccgtaacgggtccgggggtccgaaccggggg

SEQ ID NO: 357263 - DNA, 641 bp, Homo sapiens
  misc_feature: GZ8MTXP02IPE4I.22.36.D03.1.454.CMB.2.raw
  modified_base (304)..(304): a, c, t, g, unknown or other
  misc_feature (304)..(304): n is a, c, g, or t
  modified_base (441)..(441): a, c, t, g, unknown or other
  misc_feature (441)..(441): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggaggcgttggtacgaggccggggggtccctggacactctcctgtgcagcctctggattcacagtcagcagcaatgccatgagttggccncaggctccgaggggagggttgcgtagtgggtcgtcggggattggaagtgagtggtcgcccaacacacctacgcgaagcctccggtgacgggggcctcttcactcactctccgagacgacgactacgaaaacacagtnaatctagacaaatgtacacgccctgacggccgaccggacggaccgaccgggtacccgttacgttaccgttccgtacgggttaccggaaaccggtaaaaccgtaacccgtttccgttttaaacgggtttttccgggggaccccgtaccggggtaccccggtaaaccggtttccgggtaccgggggaccccgtaaccggggg

SEQ ID NO: 357264 - DNA, 631 bp, Homo sapiens
  misc_feature: GZ8MTXP02F5GY0.22.36.D03.1.454.CMB.2.raw
  modified_base (218)..(218): a, c, t, g, unknown or other
  misc_feature (218)..(218): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
tcagacatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaaccaacgagtgactagttgggtctttgactctgtctctacgtaccaacaccaccacgacccaaacccccatcatctattangtntcaccgtcgtccgcctagacgtctctcacgtctctctcgacgcgtcctacgacgtcgacgaccgaaccgtcccgtaccctaccctacctctaccgtcgtcggtctacgttagtacggacgtacgtacttacttacttactcgtacgttacgtttaaccgtttaaacttaacggtccgtaccctacgtcgttccggtttcgggttcggttacggacggacgtaccgaacggtacgtccggtccgtccggtaccgtaccgaccggaaccgtccggtcccgtaccccgtacccggtcctaccgtcccgttccgttcccccgg

SEQ ID NO: 357265 - DNA, 700 bp, Homo sapiens
  misc_feature: GZ8MTXP02HNFTL.22.36.D03.1.454.CMB.2.raw
  modified_base (315)..(315): a, c, t, g, unknown or other
  misc_feature (315)..(315): n is a, c, g, or t
tcagacatacgcgtcacgaccggtgctcgatttagctgcgtcacgatctctcttggggagctctgagagaggagcccagccctgggattttcaggtgttttcatttggtgatcaggactgaacagagagaactcaccatggagtttgggctgaagtggcttttgcttgtggcttattttaaaaggtgtcaagtgtgcggtgaaggtattggagtcgtgggggagcttggtacgaggccggggggtccctgacactctcctgtgcagcctcgtggattcacagtcagcagcaatgccagtgtacggttcgggcccnccgaggcctccggaaggggtaggggttcgcgtaggtgggtccgtaggggattagggaagtgagtggtacgcctacacaaccgtacgcctaacgggtacctcccgggtggggacggggtcccgtacgttcaactcacttctacccgaaggtacgaacgacttaaacccggaaaaactaccgtaaagtacgtaaacgtcgttacggaaacctaaagttaacgaacgaacgtccccgttacgaccgggaccgaccggacgggtaacccggaacccgggtccctttaccgttaaccgtttcgtacggtacggtaaaccggtaaaacggtaccctttacggtttaacggtttttccggggacccggtcccggggttaccgtaacccgggg

SEQ ID NO: 357266 - DNA, 587 bp, Homo sapiens
  misc_feature: GZ8MTXP02I3PI0.22.36.D03.1.454.CMB.2.raw
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttccngcacgtgggaccaacngtgactattgggtcttttgactctgtctctgtaccaacaaccaccacggacccaaaccccccatcatctatttatggtctcactcgtcgtcctcagacgtctctcatcgcttctcgacgcctacaacgtctcgccaacgaccgtccctccctaacctactctcgtggctcgtagttgaggactacgtcttaacgttatttactcgtacttacgtttaccgttttaaaactcggtaccgtacctacgtcgtttcggtttcgggtttacggccgggtacggccgtaaacggacgttcggaaccgtccgtacggtcacgtaaccgaacggtcctcgccccgtcggtactcttcccg

SEQ ID NO: 357267 - DNA, 614 bp, Homo sapiens
  misc_feature: GZ8MTXP02F90RH.22.36.D03.1.454.CMB.2.raw
  modified_base (219)..(219): a, c, t, g, unknown or other
  misc_feature (219)..(219): n is a, c, g, or t
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
  modified_base (365)..(365): a, c, t, g, unknown or other
  misc_feature (365)..(365): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtggaccaanagtnactattggtctttgactctgtctctagtaccaacacaccacgaccaaacccccatcatctattangtctcactcgccgtcctgaggtactctcctcactcgtcttcncgagcctcagtctcgacaacnccgaccctaccctactactctcgtcggtctcgtagttcgaacggtacgtacgttcttaactttacttacgtcgtacgttaacgtttacctttaaagtaccggtcctacccttacgtttccgttcggtttcgggtttccgggacggtacggtaccgtacggtaacgtccgtaacccggttccgtaccggtaccaacggcccgtaacggcccttcccggtacccccgttcggtacctacccggtttccccg

SEQ ID NO: 357268 - DNA, 518 bp, Homo sapiens
  misc_feature: GZ8MTXP02HQC69.22.36.D03.1.454.CMB.2.raw
  modified_base (337)..(337): a, c, t, g, unknown or other
  misc_feature (337)..(337): n is a, c, g, or t
  modified_base (356)..(356): a, c, t, g, unknown or other
  misc_feature (356)..(356): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (435)..(435): a, c, t, g, unknown or other
  misc_feature (435)..(435): n is a, c, g, or t
  modified_base (511)..(511): a, c, t, g, unknown or other
  misc_feature (511)..(511): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctctgtaccaacacacccagccaaacccccactcatcatttatggtgtcactcgtcgcctcagagtctctcatcgcttcncagctcaagtctgacaacncgccctccctaacnctcnctggctccgagtttcgagtacgagtactattacttactgtctagttacctttaaatcggcncctactcgttcgttggtttcgcggtacgctacggagtcgaccgtcgtcgtcacgtccgaacgctcgccctcggtcncttcccg

SEQ ID NO: 357269 - DNA, 556 bp, Homo sapiens
  misc_feature: GZ8MTXP02GT8E2.22.36.D03.1.454.CMB.2.raw
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (326)..(326): a, c, t, g, unknown or other
  misc_feature (326)..(326): n is a, c, g, or t
  modified_base (336)..(336): a, c, t, g, unknown or other
  misc_feature (336)..(336): n is a, c, g, or t
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
tcagacatacgcgtcacgaccggtgctcgatttagctgcgtcacgatctctcttgggggggtctcaggaggcagcgctctcgggacgtctccaccatggcctgggctctgctattcctcaccttcctcactcagggcacagggtcctgggcccagtctgccctgacccagcctgcctcgtgtctggatcatctggacagtcgatcagctattccngcactgggaccaacngtgactagttggtctttgactctgtctctggtaccaacaacaccagaccaaaccccccatcatctattatgtgtcactcgtcgcctcaggatctcncatcgcttcncacgctccgaagtctgaccaacncgccctaccctaaacnctctcgtgggtcctccgtagtttcgacggacgtagtaccttattacgttactgcgttaagtttacctttaaagtagtccgtacacttcgttcggttggtttcgggcgtacgtaccgacgtaaggtcgtaccgtcgtcgtacacgtcccaaggcctcgtcccccgtgtcctacctcgttccc

SEQ ID NO: 357270 - DNA, 641 bp, Homo sapiens
  misc_feature: GZ8MTXP02GP4VG.22.36.D03.1.454.CMB.2.raw
  modified_base (304)..(304): a, c, t, g, unknown or other
  misc_feature (304)..(304): n is a, c, g, or t
  modified_base (371)..(371): a, c, t, g, unknown or other
  misc_feature (371)..(371): n is a, c, g, or t
  modified_base (470)..(470): a, c, t, g, unknown or other
  misc_feature (470)..(470): n is a, c, g, or t
tcagacatacgcgtcacgaccggtgctcgatttagctgcgtcacgatctctcttgggggagagaggagcccagccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggaggcttggtacgaggccggggggtccctgacactcgtcctgtgcagcctctggattcacagtcagcagcaatgccatgagttcgggccnccgagcctccgaggggaacgggttgcgtaggtggggtcgtcggggattgggaaagtgagtgggtacnccacacaccgtacgctagaccgtccgtaggacggggcctcttcaatcaactcgtaccaggacgtacgacttaaccgaaaacacgagtagaactcgtaanactaaagtacgacgacgcctacgacggaccggacggaccggaccgtacccgtaccgttacttacgttcgtacggtaacgaaccgtaaaaccgtccgttacggttttacggtttccggggacccggtacccggtaacccggtaccgtaccgggtaccgggggaccgaccggg

SEQ ID NO: 357271 - DNA, 559 bp, Homo sapiens
  misc_feature: GZ8MTXP02G978N.22.36.D03.1.454.CMB.2.raw
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
  modified_base (391)..(391): a, c, t, g, unknown or other
  misc_feature (391)..(391): n is a, c, g, or t
  modified_base (553)..(553): a, c, t, g, unknown or other
  misc_feature (553)..(553): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtctttgactctgtctcctgtaccaacaacaccagaccaaaccccccatcatcattangtntcactcgtcgccctcaggcgtctcctcactcgcttctcacggcctccaagtctaggaccaacaccggtccctaccctaaacacttcncgtgggcctacgtagtttgacggacgtagtaccttacttattactgacttacgtttaactttaaagtacggcacctagttcgttcggttggtttacggcggtacgccgaaccggagtacgccgttccgcggtcacgcccgaggcctccgcccctcggtaccncttccg

SEQ ID NO: 357272 - DNA, 592 bp, Homo sapiens
  misc_feature: GZ8MTXP02IA10I.22.36.D03.1.454.CMB.2.raw
  modified_base (219)..(219): a, c, t, g, unknown or other
  misc_feature (219)..(219): n is a, c, g, or t
  modified_base (234)..(234): a, c, t, g, unknown or other
  misc_feature (234)..(234): n is a, c, g, or t
  modified_base (306)..(306): a, c, t, g, unknown or other
  misc_feature (306)..(306): n is a, c, g, or t
  modified_base (392)..(392): a, c, t, g, unknown or other
  misc_feature (392)..(392): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagctatttccngcacgtgggaccaanagtgactagttggtctttgactctgtctcctgtaccaacacaccagacccaacccccatcatctattatgtntcactcgtcgccctgagtctctcctcactcgcttctcgcgtcctaccgaagtcctacggaccaaccgaccgccctaccctaaaccnctccgtcgtcggtccttacgtagttacggacgtacgtacgttacttaactttattactgtacttacgtttacttaagtacgcctacctacgttcgttcggttcggttcggacggtacgaccgtacggtacgtccggtaccgtccgtacgtacgaccgtaacccgtacgtccgtcccgtccccgtcggtcctaccgtcccg

SEQ ID NO: 357273 - DNA, 581 bp, Homo sapiens
  misc_feature: GZ8MTXP02FKXWA.22.36.D03.1.454.CMB.2.raw
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccagcaaaccccccaactcatcattatggtgtcactcgtcggccctcagagtctcctcatcgcttctcagctcaagtctggcaacacggccctacctaaccatcctctgggctccagtttgagacgagtctacttattactacgtctacgtttaccctttaaaattacggcgtacccacttccgtccgttagggtttttccggcgggtaacggccgaaaccgtaacggtacggtaacccgtcccgttaccggtcaaccggccccgaaaaggcctaccggcccccctcgggttccacctttcccg

SEQ ID NO: 357274 - DNA, 825 bp, Homo sapiens
  misc_feature: GZ8MTXP02FT6AP.22.36.D03.1.454.CMB.2.raw
  modified_base (595)..(595): a, c, t, g, unknown or other
  misc_feature (595)..(595): n is a, c, g, or t
tcagacatacgcgtcacgaccggtgctcgatttagctgcgtcacgatctctcttggggtggggtctcaggaggcagcgctctcgggacgtctccaccatggcctgggctctgctattcctcaccttcctcactcagggcacagggtcctgggcccagtctgccctgacccagcctgcctccgtgtctggatcatcgtggacagtcgatcagtcttactttccgtgacctacggtacgggaaacccaaacgtaggtacgtaacgttaggtttcggggttttcttttacggtaccttcgttcggttacccttacccggttaaccggtaaaaccccaaaaccgaaaccccgaacccccggaaccccggtaaacccccccaaaaaccccccccctaatacctaacgtttaccttaaagttttaggtcgggttacctacccgtaacccggttcccgggtccccggtccccctaacggtacggggttaccttccctccctaacctacgttcccgttcctttacgtaccggaccgggtccctaaccgtaacggttccgtacgggaccctaaacgccccggtccccttaaccgtcgaaccctnttccgtcgggttcggaccctaccggaaggtcgtaacggaaaagtcgtaacgggtacgtacttaggttaactttacgttacggtcctacgtcgtcttacggttacttcggacgtaccggtccctacttaacccggtgggtttggtcggggaccgggaacgggttaacggacccgtaacggccgttaacccggtaccggtaccggaccggtccgaacccggtaccgtcccgg

SEQ ID NO: 357275 - DNA, 667 bp, Homo sapiens
  misc_feature: GZ8MTXP02J2LXR.22.36.D03.1.454.CMB.2.raw
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
  modified_base (331)..(331): a, c, t, g, unknown or other
  misc_feature (331)..(331): n is a, c, g, or t
  modified_base (369)..(369): a, c, t, g, unknown or other
  misc_feature (369)..(369): n is a, c, g, or t
tcagacatacgcgtcacgaccggtgctcgatttagctgcgtcacgatctctcttggggagctctgagagaggagcccagcccctgggattttcaggtgttttcatttggtgatcaggactgaacagagagaactcaccatggagtttgggctgaagtggcttttgcttgtggctattttaaaaggtgtcaagtgtgcggtgaaggtattggagtcgtgggggagcgttggtacgaggcccgggggggtcctggacactctcctgtgcagcctntggattcanagtcagcagcaatgccntgagtttcggccncaggctcgagggagggttncgagtggtcgtggggtattggaagtgagtggtcgaccncacaccgtacgcgaacggaacctttccgggagggaacgggggtccccggtactttacccgtaacgtaccgtactacccgtaccgaacggaacggtaaaccggtaacgtttaaacccggaaaacctaaccgaagtaacggtaactacgtacggaacctaaatcgttaacgacggtaccctacgacgaccggaccggaacggaccgaccggtccgtaccttaccgttcgtcggttaacgacgtaaacgtaccgttacgttacggttttccgggacccggtacgggtacccgttaacccgg
